(12) United States Patent
Park et al.

(10) Patent No.: US 11,293,019 B2
(45) Date of Patent: Apr. 5, 2022

(54) CHIMERIC GENOME ENGINEERING MOLECULES AND METHODS

(71) Applicants: GFLAS Life Sciences, Inc., Seoul (KR); SEOUL NATIONAL UNIVERSITY R&DB FOUNDATION, Seoul (KR)

(72) Inventors: Jongjin Park, Seoul (KR); Ji Young Yoon, Seoul (KR); Sunmee Choi, Seoul (KR); Mijin Park, Seoul (KR); SIki Park, Seoul (KR); Aiden Y. Park, Seoul (KR); Jung Hyuk Lee, Seoul (KR); Junghak Lim, Seoul (KR); Dong Wook Kim, Seoul (KR); Sunghwa Choe, Seoul (KR)

(73) Assignees: GFLAS LIFE SCIENCES, INC., Seoul (KR); SEOUL NATIONAL UNIVERSITY R&DB FOUNDATION, Seoul (KR)

( * ) Notice: Subject to any disclaimer, the term of this patent is extended or adjusted under 35 U.S.C. 154(b) by 0 days.

(21) Appl. No.: 16/955,639

(22) PCT Filed: Dec. 21, 2018

(86) PCT No.: PCT/IB2018/001581
§ 371 (c)(1),
(2) Date: Jun. 18, 2020

(87) PCT Pub. No.: WO2019/123014
PCT Pub. Date: Jun. 27, 2019

(65) Prior Publication Data
US 2021/0054362 A1 Feb. 25, 2021

Related U.S. Application Data

(60) Provisional application No. 62/622,025, filed on Jan. 25, 2018, provisional application No. 62/609,727, filed on Dec. 22, 2017.

(51) Int. Cl.
*C12N 15/10* (2006.01)
*C12N 9/22* (2006.01)
*C12N 15/113* (2010.01)

(52) U.S. Cl.
CPC ............ *C12N 15/102* (2013.01); *C12N 9/22* (2013.01); *C12N 15/113* (2013.01); *C07K 2319/09* (2013.01); *C07K 2319/21* (2013.01); *C07K 2319/80* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| 8,673,557 | B2 | 3/2014 | Scharenberg et al. |
| 9,540,623 | B2 | 1/2017 | Silva et al. |
| 10,633,642 | B2 | 4/2020 | Joung et al. |
| 2012/0276074 | A1 | 11/2012 | Scharenberg et al. |
| 2016/0304855 | A1 | 10/2016 | Stark et al. |

FOREIGN PATENT DOCUMENTS

| CN | 105916987 A | 8/2016 |
| CN | 106995813 A | 8/2017 |
| WO | WO-2014089290 A1 | 6/2014 |
| WO | WO-2014144288 A1 | 9/2014 |
| WO | WO-2016205711 A | 12/2016 |
| WO | WO-2017026883 A1 | 2/2017 |
| WO | WO-2017053879 A1 | 3/2017 |

OTHER PUBLICATIONS

Baker et al., RAC-tagging: Recombineering and Cas9-assisted targeting for protein tagging and conditional analyses. Scientific Reports (6) :25529 ( 2016).
Chen et al., CRISPR/Cas9-based Genome Editing in *Pseudomonas aeruginosa* and Cytidine Deaminase-Mediated Base Editing in *Pseudomonas* Species. Cell Press 6(31): 222-231 (2018).
Clements et al., RICE CRISPR: Rapidly Increased Cut Ends by an Exonuclease Cas9 Fusion in Zebrafish. Genesis. 55(8): 11 pages (2017).
Lin et al., Fusion of SpCas9 to *E. coli* Rec A protein enhances CRISPR-Cas9 mediated gene knockout in mammalian cells. J Biotechnol. 247:42-49 (2017).
Lovett et al., Identification and purification of a single-stranded-DNA-specific exonuclease encoded by the recJ gene of *Escherichia coli*. PNAS 86(8): 2627-2631 (1989).
Radovcic et al., CRISPR-Cas adaptation in *Escherichia coli* requires RecBCD helicase but not nuclease activity, is independent of homologous recombination, and is antagonized by 5' ssDNA exonucleases. Nucleic Acids Research 46(19):10173-10183 (2018).

(Continued)

*Primary Examiner* — Kagnew H Gebreyesus
(74) *Attorney, Agent, or Firm* — Wilson Sonsini Goodrich & Rosati

(57) ABSTRACT

The present disclosure provides compositions and methods for increasing mutation efficiency and homologous recombination rates of site-specific endonucleases. The compositions and methods comprise a chimeric polypeptide comprising a site-specific endonuclease or a domain thereof and a functional moiety. The current inventions relate to functional enhancement of the CRISPR-Cas enzymes. Disclosed herein include possible variants and their intended improvements.

26 Claims, 146 Drawing Sheets
Specification includes a Sequence Listing.

(56) References Cited

OTHER PUBLICATIONS

Belhaj et al., Plant genome editing made easy: targeted mutagenesis in model and crop plants using the CRISPR/Cas system. Plant Methods 9(1):39 (2013).
Bortesi L, Fischer R. The CRISPR/Cas9 system for plant genome editing and beyond. Biotechnol Adv. 33(1):41-52 (2015).
Ceska et al., A helical arch allowing single-stranded DNA to thread through T5 5'-exonuclease. Nature 382(6586):90-93 (1996).
Cho et al., Targeted genome engineering in human cells with the Cas9 RNA-guided endonuclease. Nat Biotechnol 31(3):230-232 (2013).
Clements et al., RICE CRISPR: Rapidly increased cut ends by an exonuclease Cas9 fusion in zebrafish. Genesis. 55(8): 1-6 (2017).
DiCarlo et al., Genome engineering in *Saccharomyces cerevisiae* using CRISPR-Cas systems. Nucleic Acids Res 41(7):4336-4343 (2013).
Fagerlund et al., The Cpf1 CRISPR-Cas protein expands genome-editing tools. Genome Biol 16:251 (2015).
Gaj et al., ZFN, TALEN, and CRISPR/Cas-based methods for genome engineering. Trends Biotechnol 31(7):397-405 (2013).
Gansz et al., Gene product dsbA of bacteriophage T4 binds to late promoters and enhances late transcription. Mol Gen Genet 225(3):427-434 (1991).
Garforth et al., Structure-specific DNA binding by bacteriophage T5 5'-3' exonuclease. Nucleic Acids Res 25(19):3801-3807 (1997).
Jinek et al., A programmable dual-RNA-guided DNA endonuclease in adaptive bacterial immunity. Science. 337(6096):816-821 (2012).
Kanchiswamy et al., Fine-Tuning Next-Generation Genome Editing Tools. Trends Biotechnol 34(7):562-574 (2016).
Kowalczykowski et al., Biochemistry of homologous recombination in *Escherichia coli*. Microbiol Rev 58(3):401-465 (1994).
Kroeker et al., Mung bean nuclease I. Terminally directed hydrolysis of native DNA. Biochemistry. 1976;15(20):4463-4467.
Laskowski et al., Mung bean nuclease I. Physical, chemical, and catalytic properties. Biochemistry 15(20):4457-4463 (1976).
Liu et al., Application of CRISPR/Cas9 in plant biology. Acta Pharm Sin B 7(3):292-302 (2017).
Lovett ST. The DNA Exonucleases of *Escherichia coli*. EcoSal Plus 4(2) (2011).
Makarova et al., Annotation and Classification of CRISPR-Cas Systems. Methods Mol Biol 1311:47-75 (2015).
Mali et al. CAS9 transcriptional activators for target specificity screening and paired nickases for cooperative genome engineering. Nat Biotechnol 31(9):833-838 (2013).
Malnoy et al., DNA-Free Genetically Edited Grapevine and Apple Protoplast Using CRISPR/Cas9 Ribonucleoproteins. Front Plant Sci 7:1904 (2016).
Mazur et al., Excision of 3' termini by the Trex1 and TREX2 3'->5' exonucleases. Characterization of the recombinant proteins. J Biol Chem. 276(20):17022-17029 (2001).
McCutchan et al., Mung bean nuclease cleaves Plasmodium genomic DNA at sites before and after genes. Science. 225(4662):625-628 (1984).
PCT/IB2018/001581 International Search Report and Written Opinion dated May 28, 2019.
Sadeghi et al., Inducing indel mutation in the SOX6 gene by zinc finger nuclease for gamma reactivation: An approach towards gene therapy of beta thalassemia. J Cell Biochem 119(3):2512-2519 (2018).
Shevelev et al., The 3' 5' exonucleases. Nat Rev Mol Cell Biol 3(5):364-376 (2002).
Shmakov, S., et al., Diversity and evolution of class 2 CRISPR-Cas systems. Nat Rev Microbiol 15(3):169-182 (2017).
Woo et al. DNA-free genome editing in plants with preassembled CRISPR-Cas9 ribonucleoproteins. Nat Biotechnol 33(11):1162-1164 (2015).
Yang et al,. Mutational analysis of residues in the nucleotide binding domain of human terminal deoxynucleotidyl transferase. J Biol Chem. 269(16):11859-11868 (1994).
Zetsche et al. Cpf1 is a single RNA-guided endonuclease of a class 2 CRISPR-Cas system. Cell 163(3):759-771 (2015).
Zhang et al. Efficient and transgene-free genome editing in wheat through transient expression of CRISPR/Cas9 DNA or RNA. Nat Commun 7:12617 (2016).

Schematic of variants of CRISPR genome editing enzymes

- TAG; purification tag like 6X His
- NLS; nuclear localization signal
- DME, DBP or TdT ; DNA modifying enzyme (DME), DNA binding protein (DBP), or deoxyribonucleotidyl transferase (TdT) fused in frame with N- or C-terminus of GE effector protein
- Cas9, Cpf1, etc.; CRISPR genome editing effector proteins 1/32 deletion
One six-nt deletion

FIG. 10

ADCY5: 641bps
KCNJ6: 566 bps
CNTPNA2: 300 bps
Chr.5: 605bps

ADCY5: 377+264
KCNJ6: 352+214
CNTPNA2: 183+117
Chr.5: 355+250

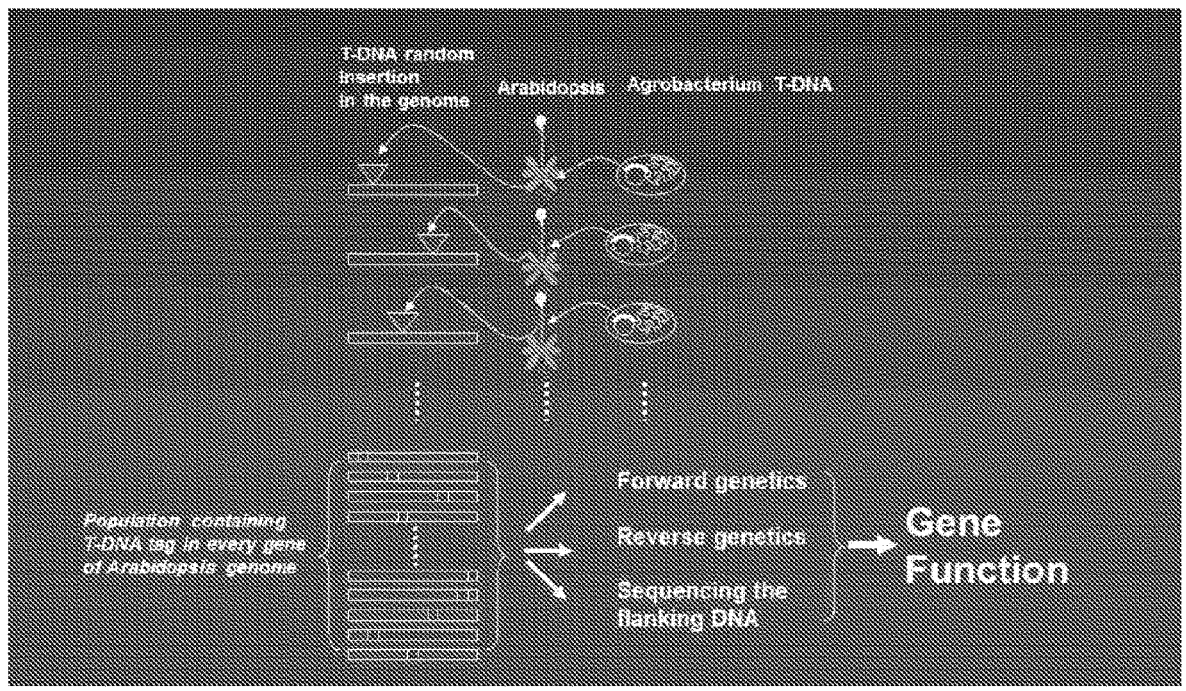
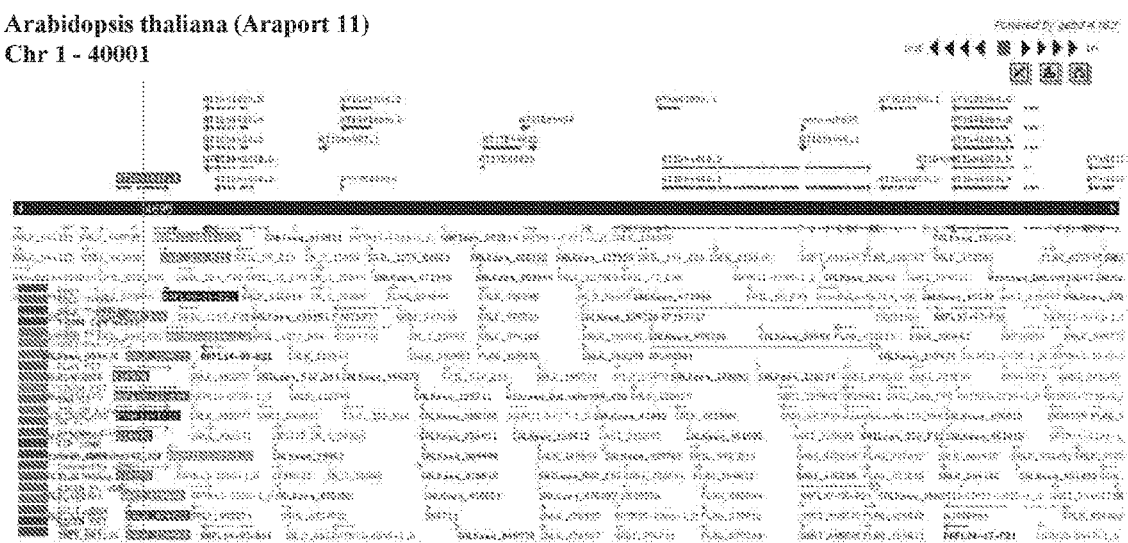
FIG. 24

Types of CRISPR systems
Single or multiple polypeptides of the effector proteins Hsu et al., 2014. Cell.

Ribonucleoprotein (RNP) and nucleic acids

Advantages of RNP methods over DNA and RNA approaches

1. High editing efficiency
2. Quick Reaction
3. Low off-targeting
4. No foreign DNA use
5. Simple multiplexing (Liang et al., Thermo Fisher Scientific)

Procedures to prepare CRISPR enzymes
Purification of the CRISPR/Cas9 and Cas9 Plus
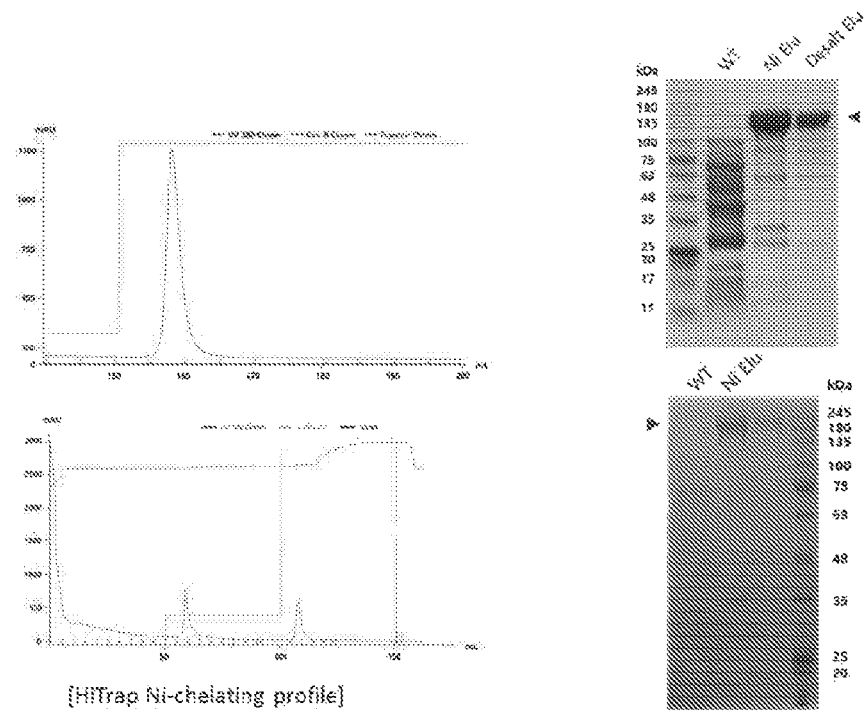
[HiTrap Ni-chelating profile]
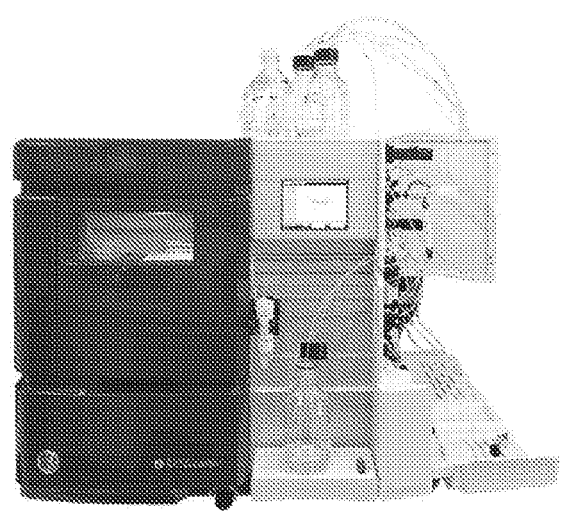
FIG. 30

Procedures to prepare CRISPR enzymes
sgRNA preparation and holoenzyme
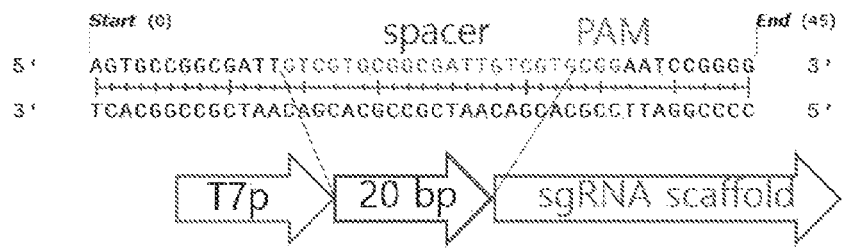
1. Synthetic DNA Oligodimers
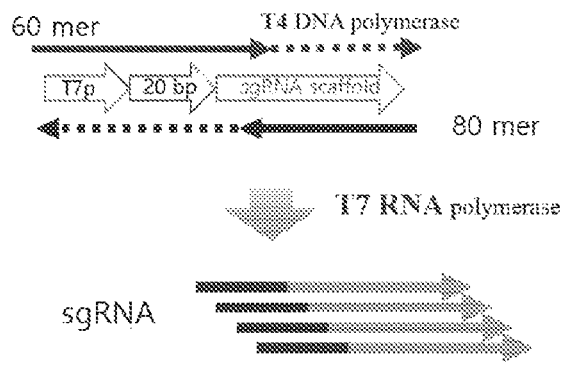
2. Plasmid Templates
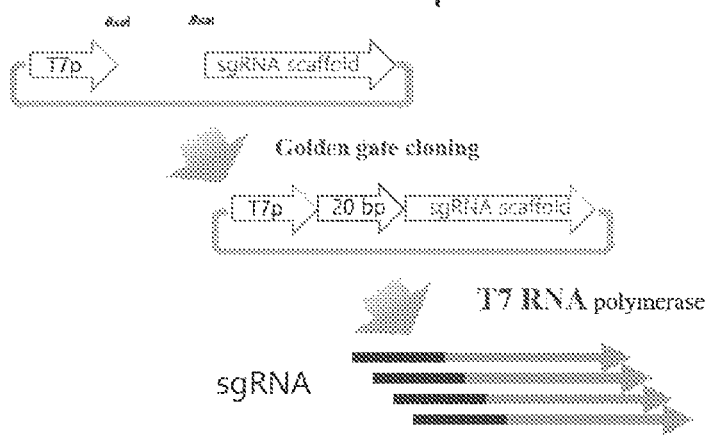
FIG. 31

Design of CRISPR PLUS™

Schematic of variants of CRISPR genome editing enzymes

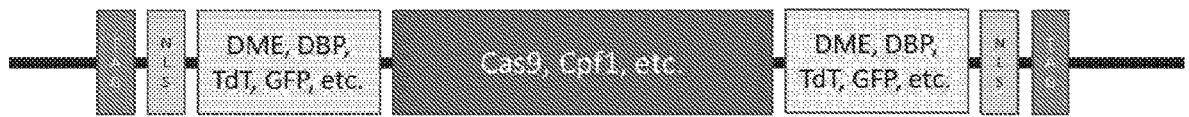

- TAG; purification tag like 6X His
- NLS; nuclear localization signal
- DME, DBP, TdT, GFP, etc. ; DNA modifying enzyme (DME), DNA binding protein (DBP), deoxyribonucleotidyl transferase (TdT), or stabilizing protein like GFP or other proteins fused in frame with N- or C-terminus of GE effector protein
- Cas9, Cpf1, etc.; CRISPR genome editing effector proteins TAG, NLS, DME, DBP, TdT, GFP etc. can be located at the N-terminus, C-terminus, or in an internal location relative to the effector protein (e.g., Cas9, Cpf1)

FIG. 33

Functional enhancements in human HEK293T cells
Comparison of T7E1 results
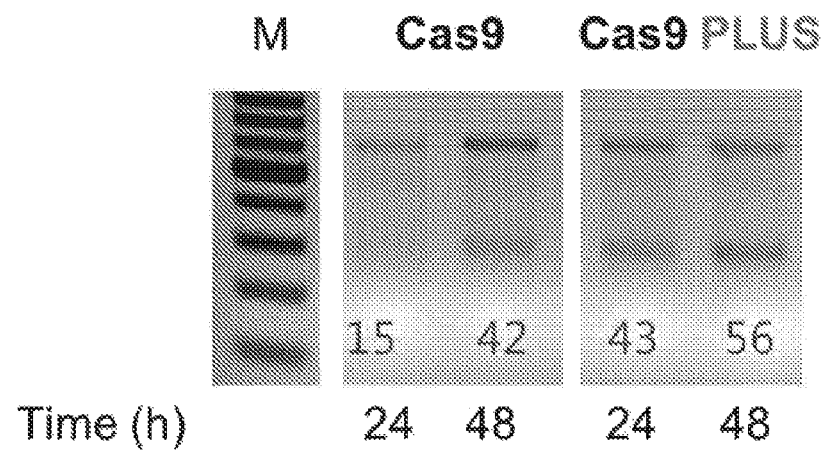
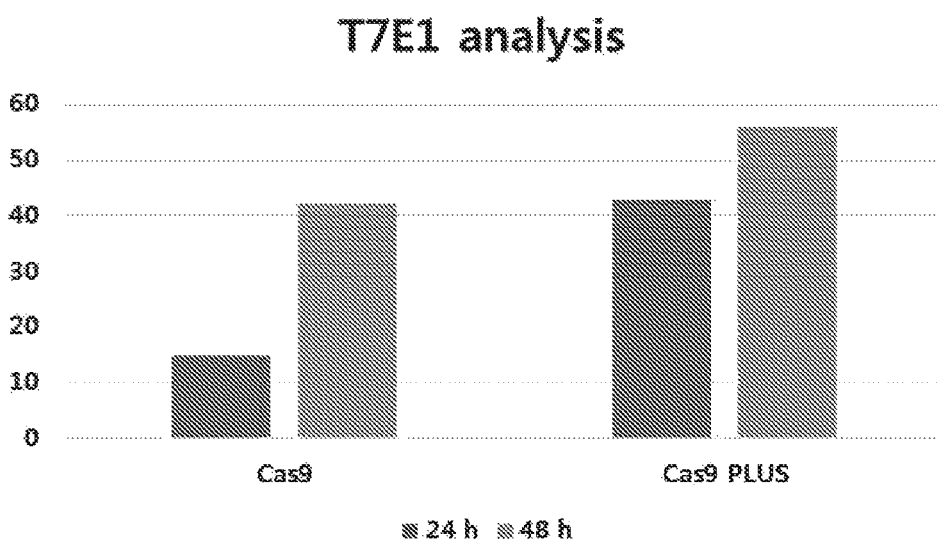
FIG. 35

Genes to edit

Example, Arabidopsis brassinosteroid mutants

Chung and Choe (Critical Reviews in Plant Sciences, 32:396–410, 2013)

Double target method is used to delete the intervening DNA

1. DNA spanning the 2 target sites was PCR amplified
2. Cloned into a TA-cloning vector
3. Clones were randomly selected and Sanger sequenced: 23/40 = 57.5 (%)

Off-target effects are low in Arabidopsis
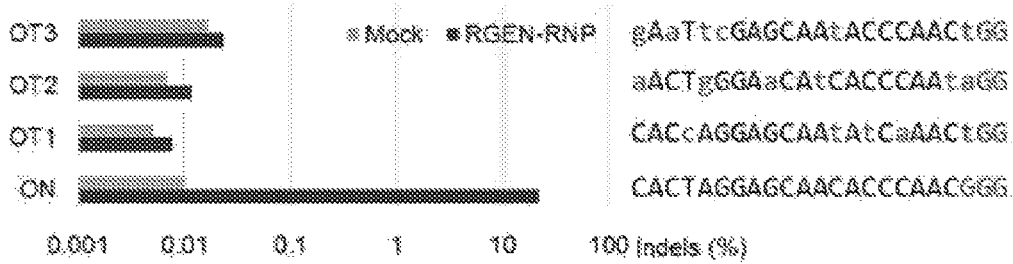
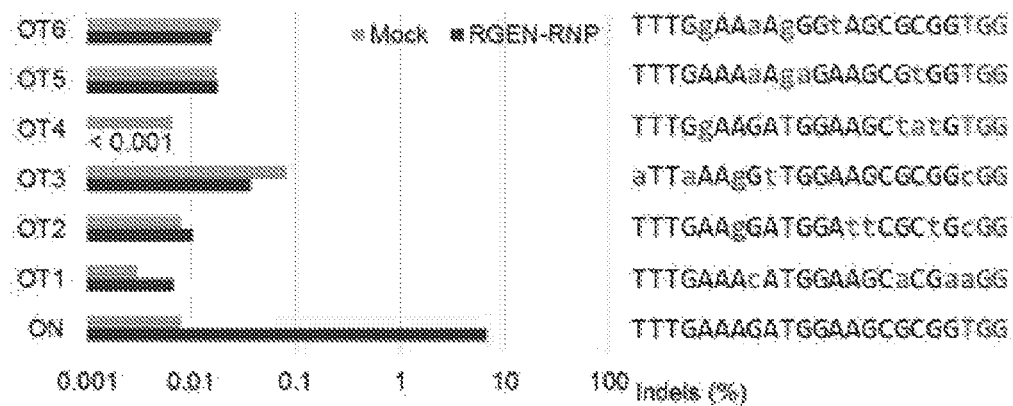
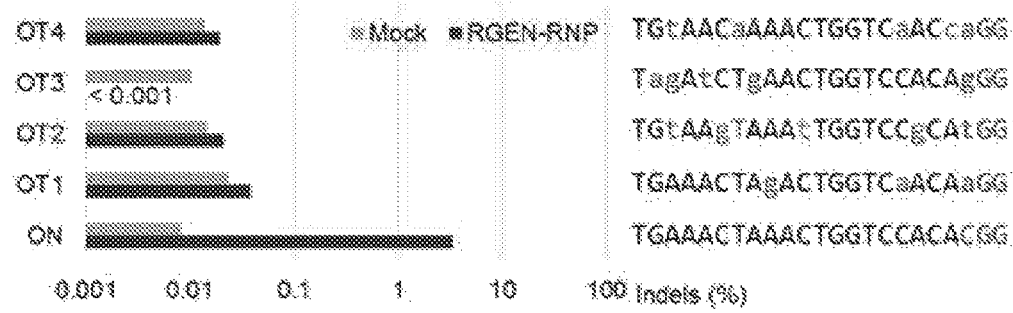
FIG. 41

Ribonucleoproteins (RNPs) – mediated genome editing followed by lettuce plant regeneration Regeneration of plantlets after GE in lettuce Growth and Division of lettuce Protoplasts
(*LsBIN2* (RG4) editing line)

Can we tell edited clones from non-edited ones?

→ Yes by RNA guided endonuclease (RGEN)

Kim JM, Kim D, Kim S, Kim JS (2014) Genotyping with CRISPR-Cas-derived RNA-guided endonucleases. Nature Commu 5: 3157

Overall phenotype is not altered in biallelic heterozygous line
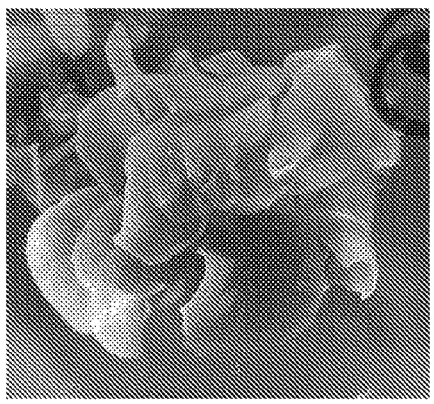
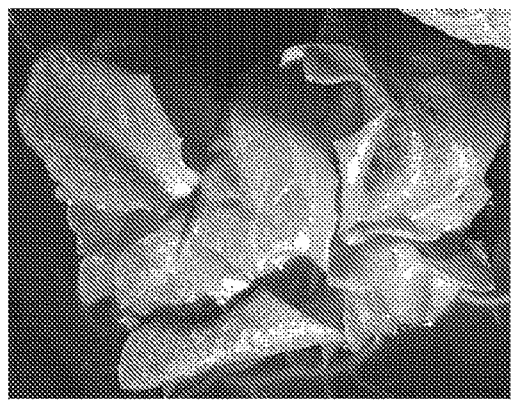
26 (WT) ATCACAGTGATGCTCGT-CAAAGG
ATCACAGTGATGCTCGT-CAAAGG WT
24-A1 ATCACAGTGATGCTGTTCAAAGG +1
-A2 ATCACAGTGATGCTG--CAAAGG -1
FIG. 50

Number of potential off-target sites in the lettuce genome (Cas-OFFinder www.regenome.net)

| | No. of mismatches to on-target site | | | | | | |
|---|---|---|---|---|---|---|---|
| | 0 | 1 | 2 | 3 | 4 | 5 | Total |
| No. of potential off-target sites | 1 (on-target) | 0 | 1 | 4 | 27 | 349 | 382 |
| No. of sites with appropriate PCR primers | 1 | 0 | 1 | 3 | 24 | 72 | 101 |
| No. of sites amplified successfully | 1 | 0 | 1 | 3 | 22 | 65 | 92 |

FIG. 52

Low Indel frequencies at the on-target and 91 potential off-target sites

| Site name | Sequence | WT Indels(%) | T0-20 Indels(%) | T0-24 Indels(%) | T0-25 Indels(%) |
|---|---|---|---|---|---|
| On-target | ATCACAGTGATGCTCGTCAAAGG | 0.021 | 99.912 | 99.867 | 45.042 |
| OT1 | ATCACAGTGcgGCTCGTCAAgGG | 0.022 | 0.039 | 0 | 0 |
| OT2 | caCACAGTGATGtTCGTCAAgGG | 0 | 0.014 | 0.024 | 0.013 |
| OT3 | ATacCAGgGATGCTCGTCAAtGG | 0 | 0 | 0 | 0 |
| OT4 | ATCAtAGTGATGCTCaTgAAgGG | 0.013 | 0.03 | 0.019 | 0 |
| OT5 | ATCACAtTGATGCTCtaCAtAGG | 0.023 | 0.033 | 0.029 | 0.012 |
| OT6 | ATaACAGaGAcGaTCGTCAAAGG | 0.029 | 0.03 | 0.014 | 0.027 |

FIG. 53

DNA vs RNP method: Unwanted DNA integration issue

Cas9 plasmid 3 mg + sgRNA plasmid 3 mg

```
CACTAGGAGCAACACCC----------------------------AACGGG   WT
CACTAGGAGCAACACCTGATGATCAGGTCCTTCTTCACCTCCTTGTAGCCCTAACGGG + 35bp (2/90518)
```

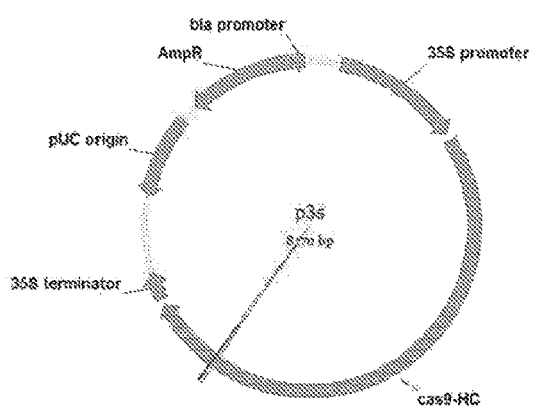

Cloning vector pYB196 T-DNA region, complete sequence
Sequence ID: gb|KJ818268.1| Length: 8616 Number of Matches: 1

| Range 1: 7023 to 7057 | | | | |
|---|---|---|---|---|
| Score | Expect | Identities | Gaps | Strand |
| 69.9 bits(35) | 1e-09 | 35/35(100%) | 0/35(0%) | Plus/Minus |

```
Query  1     GATGATCAGGTCCTTCTTCACCTCCTTGTAGCCCT  35
             |||||||||||||||||||||||||||||||||||
Sbjct  7057  GATGATCAGGTCCTTCTTCACCTCCTTGTAGCCCT  7023
```

FIG. 55

DNA-free genome editing procedure

Pros and cons of the RNP method in plants

- Pros
  - Cas9 protein expression and sgRNA processing not needed
  - No foreign DNA remained in the genome
  - Homozygous mutant at single generation
  - Simultaneous editing of multiple genes (multiplexing)
- Cons
  - Possibility of accompanying somaclonal variation
  - Difficulty regeneration of whole plants from some crop protoplasts
  - Delivery issues

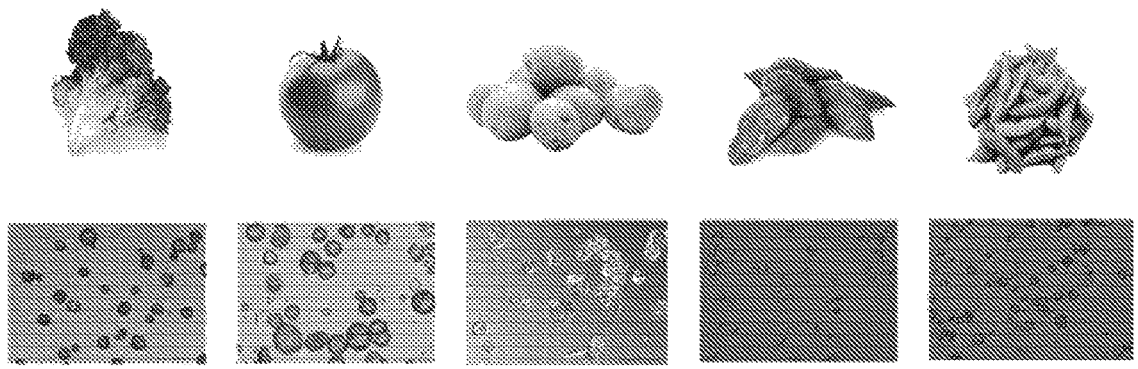

FIG. 57

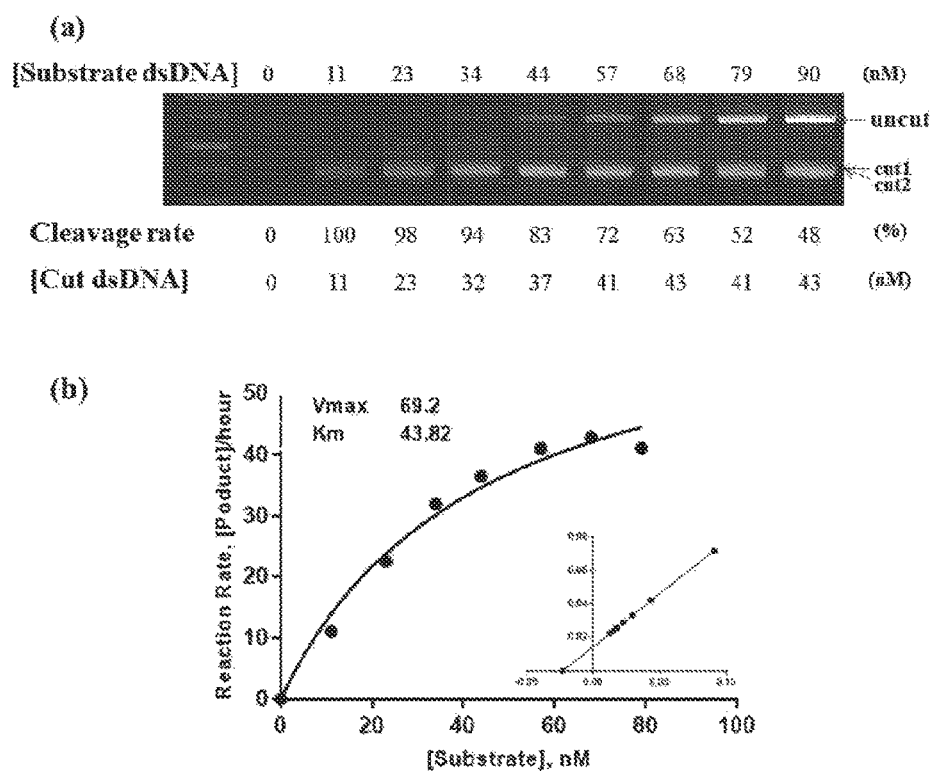

Kinetics of SpyCas9 protein activity. (a) The subtrate 1,431 bp, was used as templates (uncut). After cut, 707 bp (cut1) and 724 bp (cut2) were generated by SpCas9-sgRNA RNP complex, 120 nM SpyCas9 and 120 nM sgRNA. Substrate dsDNAs were used 11, 23, 34, 44, 57, 68, 79, 90 nM in this assay. RNP and templates were mixed and incubated for 1 h. Then, the mixture was subjected to DNA electrophoresis. The cleavage rate (%) of each DNA intensity was calculated by ImageJ program. The values of cut dsDNA was extracted from [substrate] x [cleavage rate/100]. (b) The concentrations of Substrate dsDNA and Cut dsDNA were graphed by Michael-Menton kinetics. A small plot was graphed by lineweaver-burk.

FIG. 58

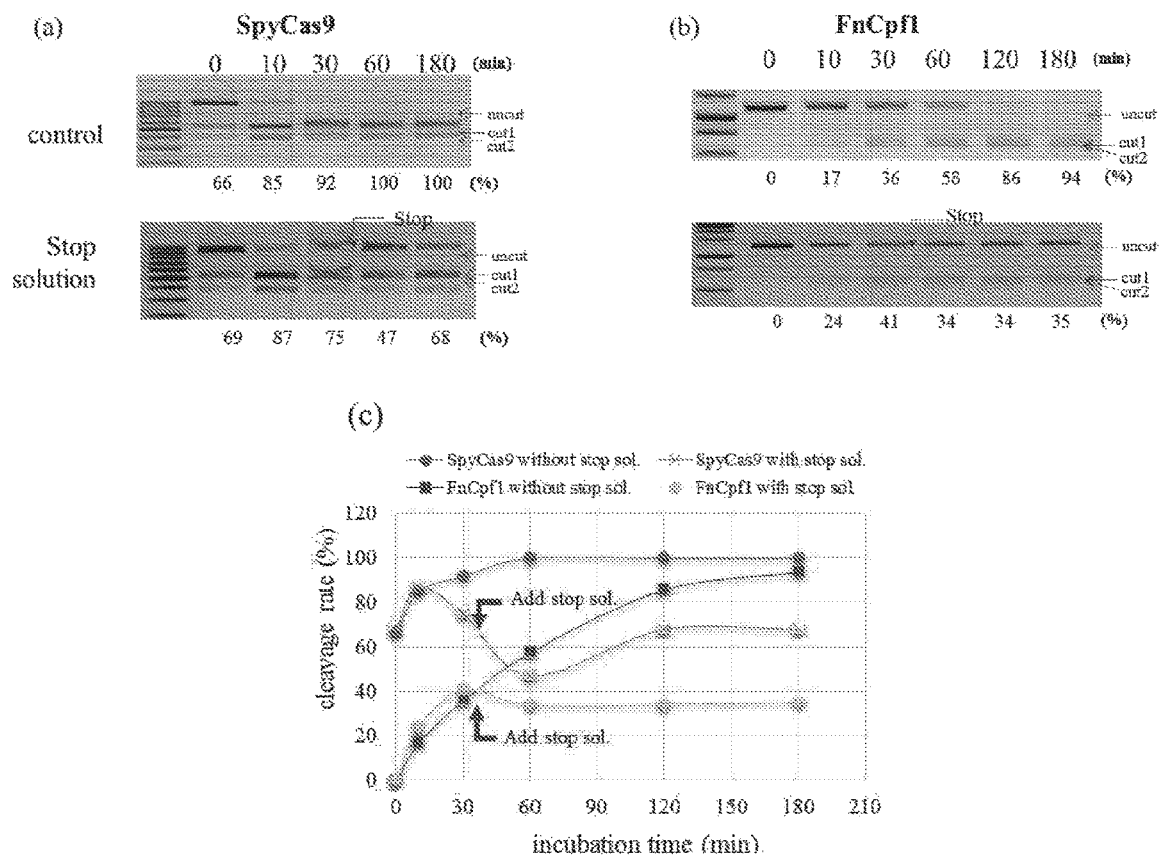

Inactivation of SpyCas9 and FnCpf1 protein activities under stop solution treatment after 30 min. (a) The PCR product– 901 bp was used as templates (uncut). After cut, 552 bp (cut1) and 349 bp (cut2) were generated by SpyCas9-sgRNA RNP complex. 300 nM SpyCas9, 612 nM sgRNA, and 27 nM PCR products were used in this assay. (b) The PCR product– 1,431 bp was used as templates (uncut). After cut, 725 bp (cut1) and 706 bp (cut2) were generated by FnCpf1-crRNA RNP complex. 500 nM FnCpf1, 700 nM crRNA, and 30 nM PCR products were used in this assay. RNP and templates were mixed and incubated for 180 min. The mixture was aliquoted after 0, 10, 30, 60, and 180 min. Then, the aliquots were subjected to DNA electrophoresis. The percentage (%) of each DNA intensity was calculated by ImageJ program. After stop solution treatment at 30 min, all uncut dsDNAs were turned to cut1 and cut2 under no stop solution, while the 53% of uncut dsDNAs were not digested any more under stop solution along with time-course after stop solution in SpyCas9. (c) Graphs show significant decreases in cleavage rate over incubation time with the addition of stop solutions in SpyCas9 and FnCpf1.

FIG. 59

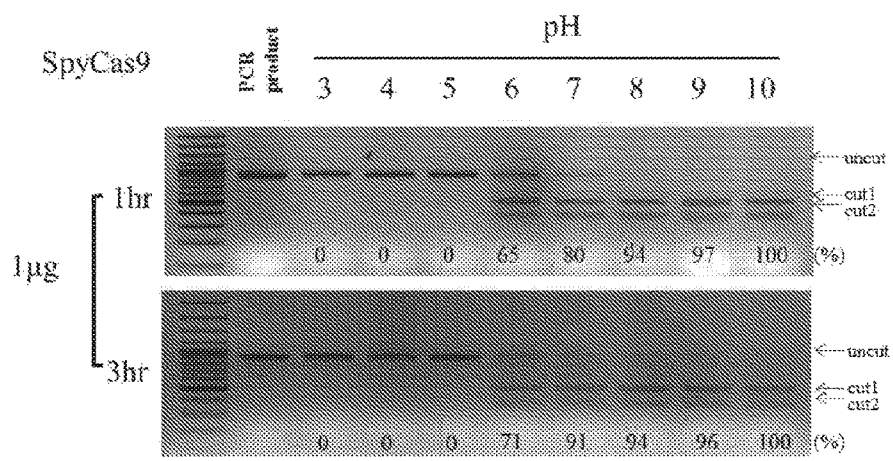

SpyCas9 protein activity depending on B buffer with pH gradients. pH range from 3 to 10 titrated by 0.5 N HCl or 1 N NaOH. The PCR product—901 bp was used as templates (uncut). After cut, 552 bp (cut1) and 349 bp (cut2) were generated by SpyCas9-sgRNA RNP complex. 300 nM SpyCas9, 612 nM sgRNA, and 27 nM PCR products were used in this assay. RNP and templates were mixed and incubated for 1 h and 3 h. Then, the mixture was subjected to DNA electrophoresis. The percentage (%) of each DNA intensity was calculated by ImageJ program. Higher pH showed higher RNP activity.

FIG. 60

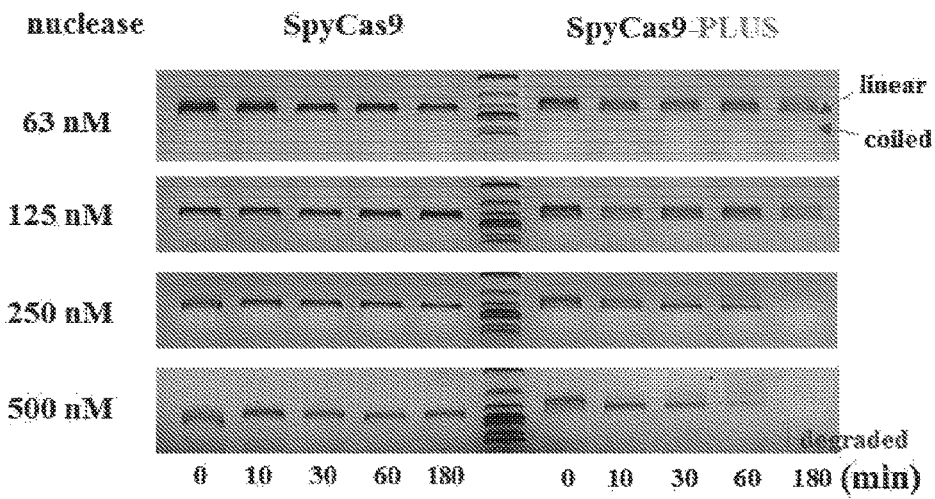

*In vitro* cleavage assay with circular dsDNA by SpyCas9 and SpyCas9-RecJ exonuclease. Circular dsDNA cleavage by SpyCas9 and SpyCas9-RecJ. Plasmid dsDNA C was used for circular dsDNA templates, and a sgRNA was used to guide Cas9 into target site before PAM. Linear dsDNA showed sharp and thick dsDNA size in DNA electrophoresis. After incubation SpyCas9/gRNA C apoproteins, SpyCas9 produced single sharp and thick dsDNA sizes without time-dependency, while SpyCas9-RecJ/gRNA showed blur, weak, thin, and tailed dsDNA, which stand for DNA degradation, after 60 – 180 minutes of incubation.

FIG. 61

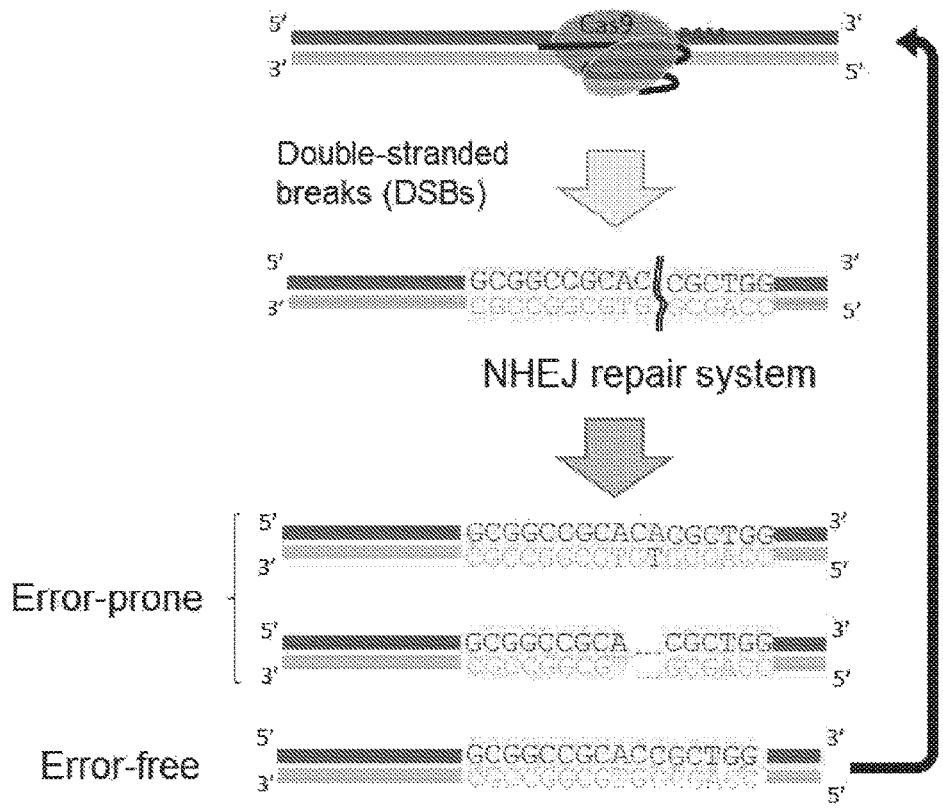

CRISPR/Cas9-mediated genome editing. Ribonucleoprotein (RNP) complex comprising Cas9 apoprotein and guide RNA finds its target sequence complementary to the guide RNA. Endonuclease domains such as HNH and RuvC II cuts 3 bases upstream from PAM (5'-NGG-3') sequences to result in double strand break (DSB). DSB is repaired by a non-homologous end joining (NHEJ) process. NHEJ frequently causes error-prone ligation, but a majority of the DSB is repaired seamlessly without insertion or deletion mutations. Repair mechanisms result in three different outcomes: 1) error-free NHEJ, error-prone NHEJ, and homologous recombination in the presence of repair templates. Due to outperformance of error-free repair mechanisms relative to error-prone repair mechanisms, the apparent mutation rate is as low as 10% *in vivo*. We found a means for pushing the tendency toward error-prone process, thereby overcoming the low mutation rate.

FIG. 62

Increasing the efficiency of error-prone NHEJ using novel Cas9-PLUS™ recombinant enzyme. Due to PLUS moiety fused to the C-terminus of Cas9 protein, the DNAs at DSB are irreversibly resected from 5' to 3' direction, which greatly decrease the possibility of error-free NHEJ process.

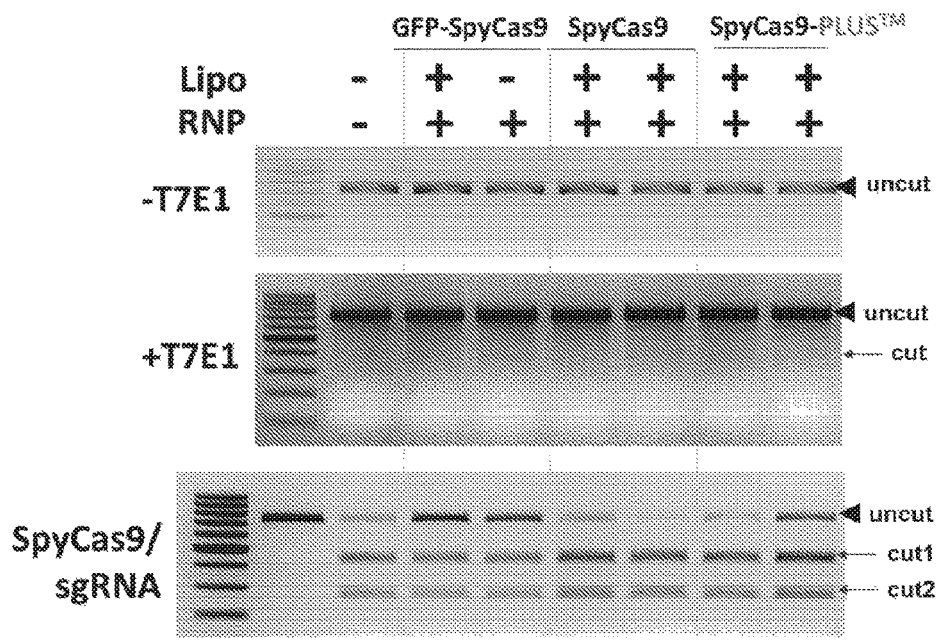

Gene editing efficiency in rice protoplasts. Each Cas9 variant and the same guide RNA against the same loci of rice Dwarf5 were transfected to protoplasts of 1-week-old rice. Rice protoplasts using lipid mediated transfection method. Cells were harvested at 48 hour after transfection for genomic DNA extraction. In order to improve discriminability of cut DNA band, alternative PCR primer pair was used and that resulted in clearer single whose sizes, which were subjected to T7E1 assay and SpyCas9/sgRNA.

FIG. 64

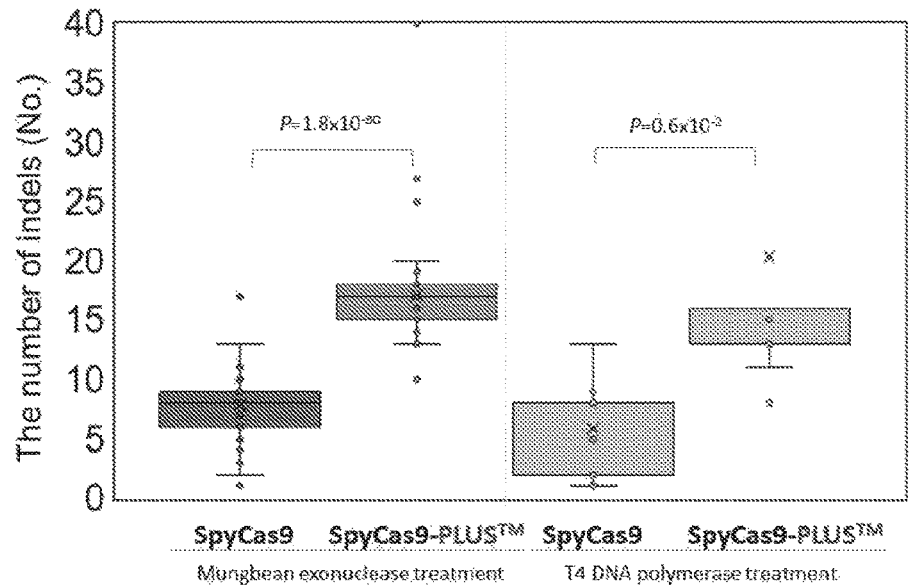

Comparison of indels in PCR product sequences after SpyCas9 and SpyCas9-PLUS™ digest circular dsDNA. SpCas9 was treated for 1 h. The cleaved dsDNAs were subjected to mungbean exonuclease treatment, and then the cleaved dsDNAs were subjected to gel electrophoresis for 40 min. The single linear DNA sizes were eluted, cleaned-up, and ligated their own linear dsDNA, and then read the cleavage site of 32 colonies by SpyCas9. One 6-nt deletion was detected (left panel). SpyCas9-PLUS™ was treated for 1 h, The cleaved dsDNAs were subjected to mungbean exonuclease treatment, and then the cleaved dsDNAs were subjected to gel electrophoresis for 40 min. The single linear DNA sizes were eluted, cleaned-up, and ligated their own linear dsDNA, and then read the cleavage site of 32 colonies by SpyCas9-PLUS™. One 3-nt, one 6-nt, and two 15-nt deletion sequences were detected (right panel).

FIG. 65

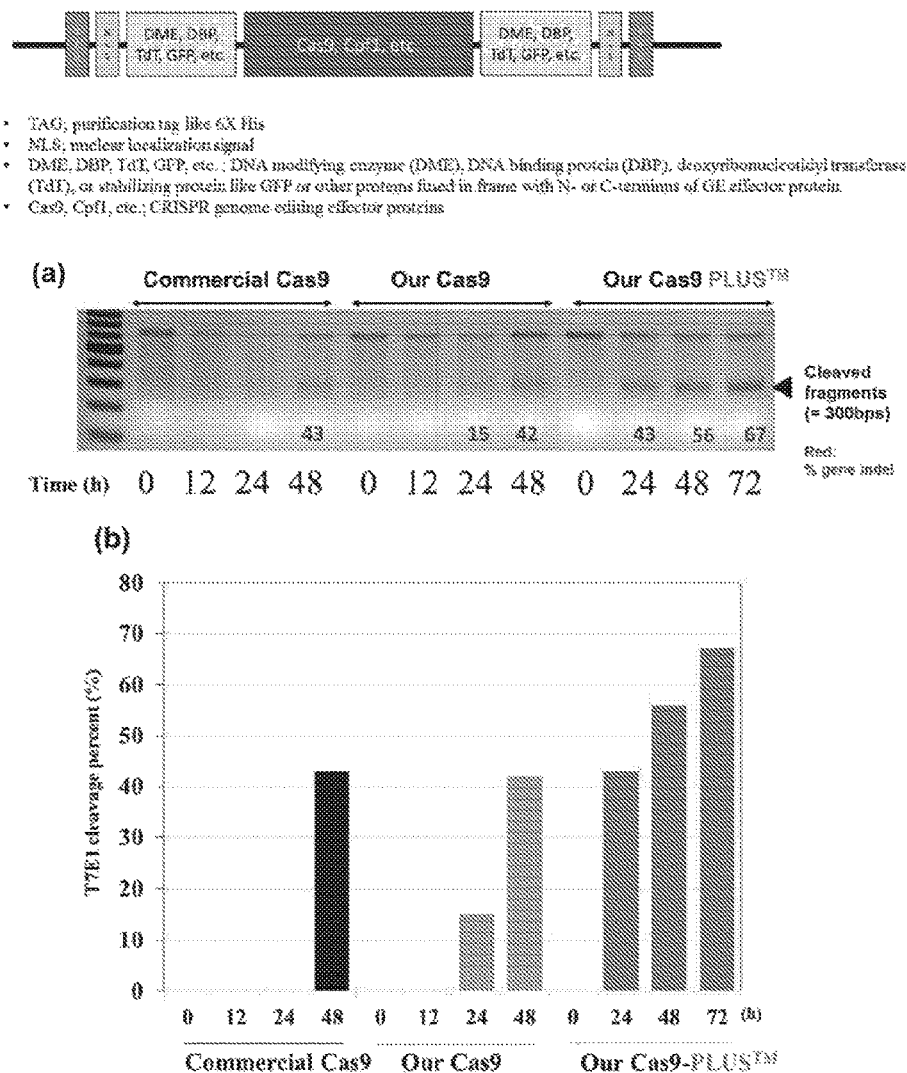

Time course of gene editing efficiency in HEK293 cells. (a-b) Each Cas9 variant and the same guide RNA against the same loci of human DHCR7 complex were transfected to HEK293 cells using a lipid mediated transfection method. Cells were harvested at different time points, from 0 hours, as a control, to 72 hours, for genomic DNA extraction. In order to improve discriminability of a cut DNA band, an alternative PCR primer pair was used and that resulted in clearer single band whose size is nearly 300 bp, which was a product of T7E1 endonuclease activity and therefore measured to compare % indel.

GGAGTGAAGGGAGAGTTTGTCAAT

GCTCAGGCAGGCACCTGCCTC

FIG. 69

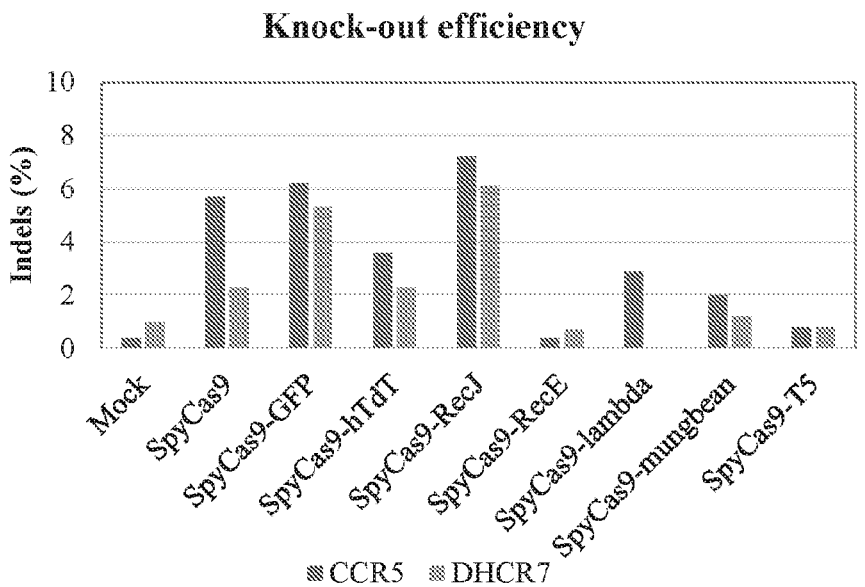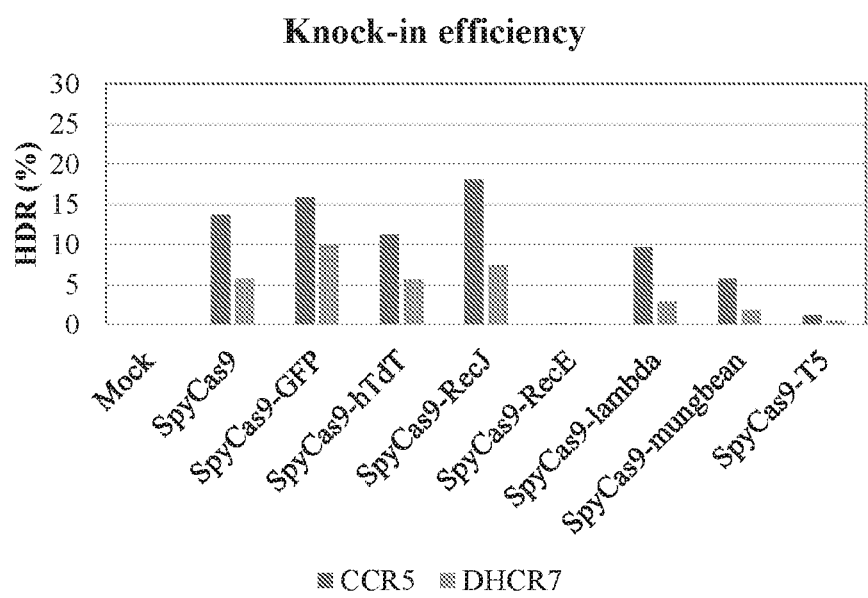
FIG. 74

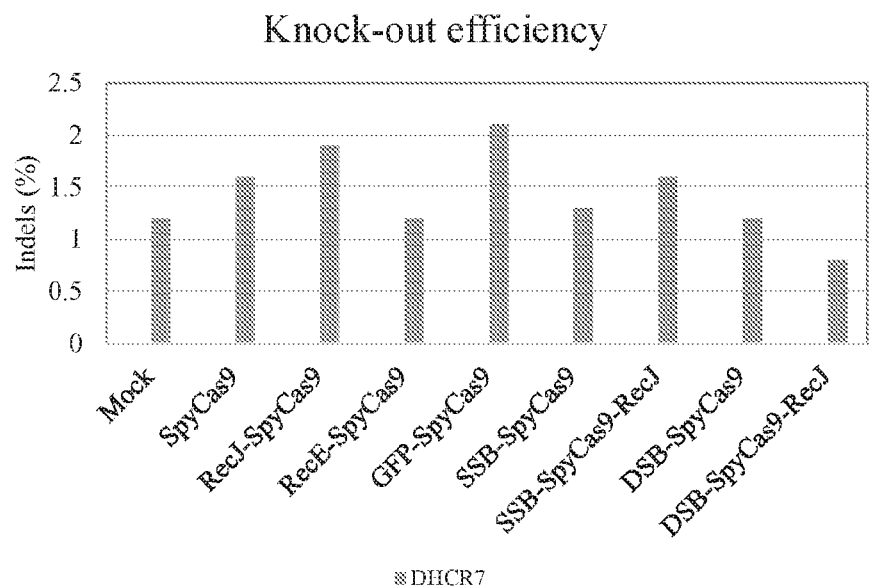
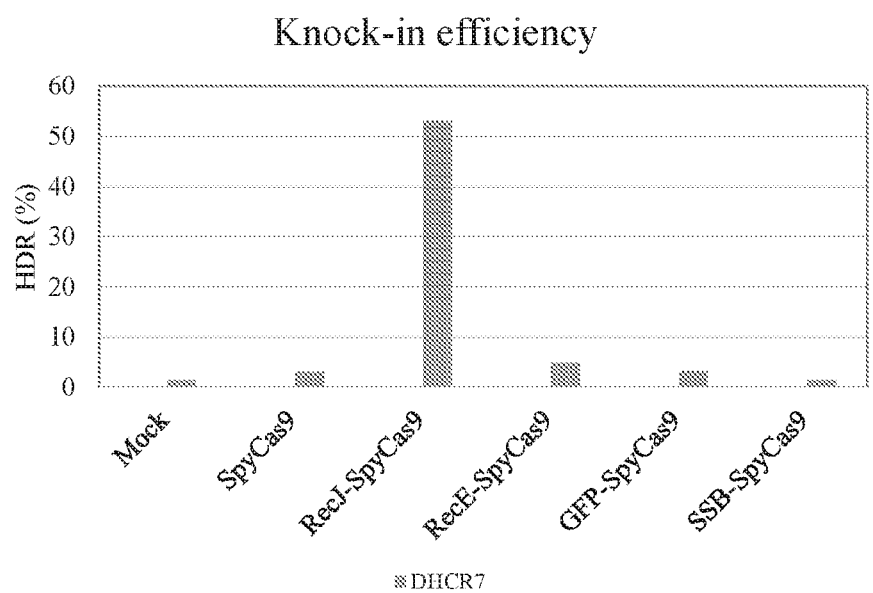
FIG. 89

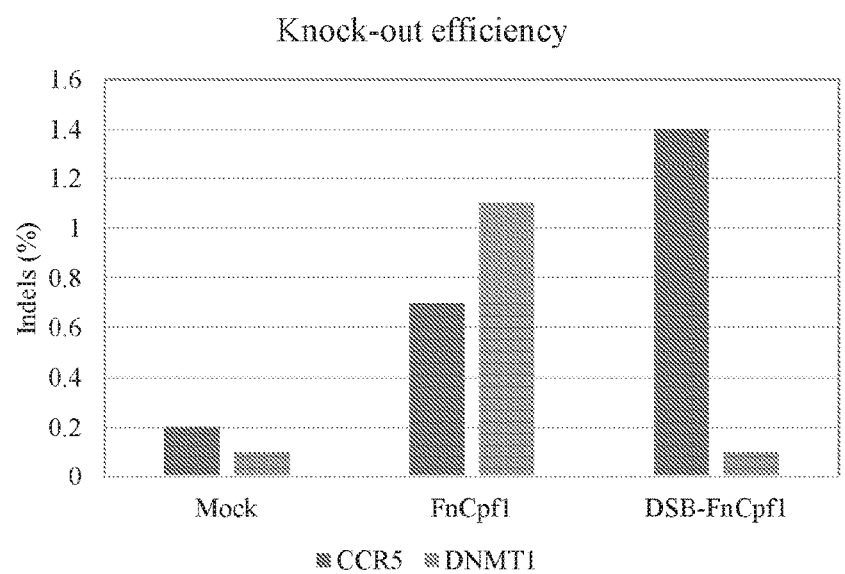
| Percent change in efficiency of DSB-FnCpf1 over FnCpf1 | | |
|---|---|---|
| | CCR5 | DNMT1 |
| DSB-FnCpf1 | +200% | -90% |
FIG. 125

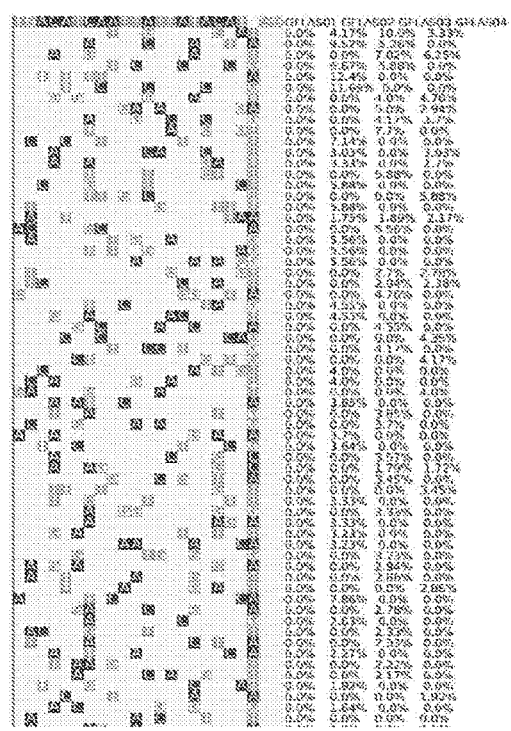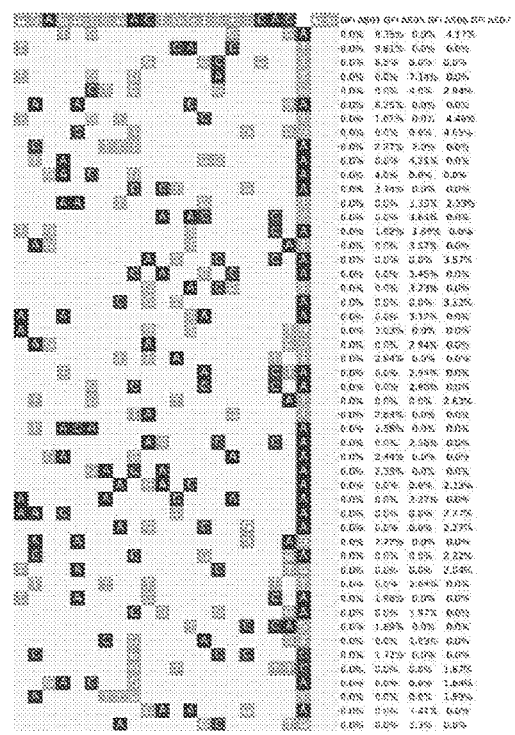
FIG. 130

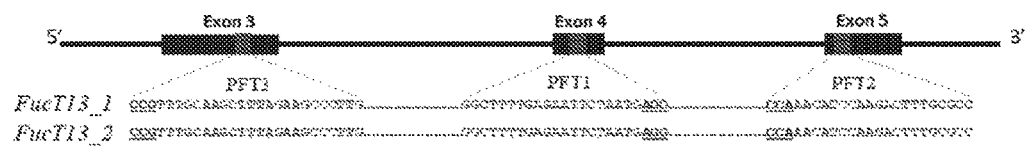
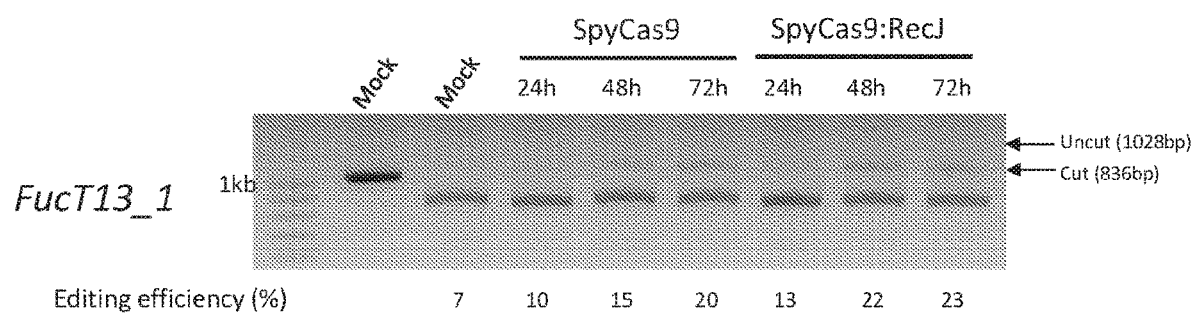
FIG. 131

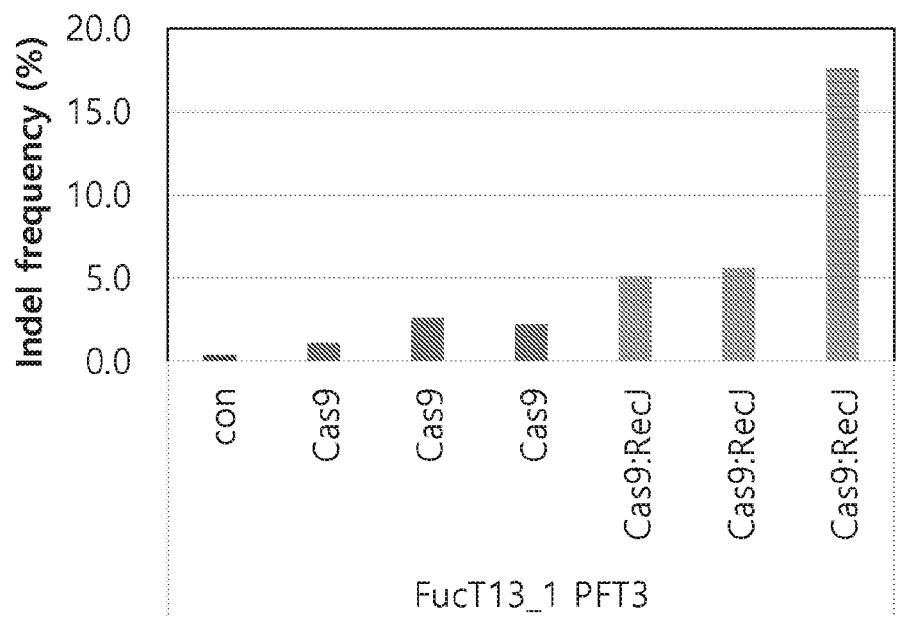
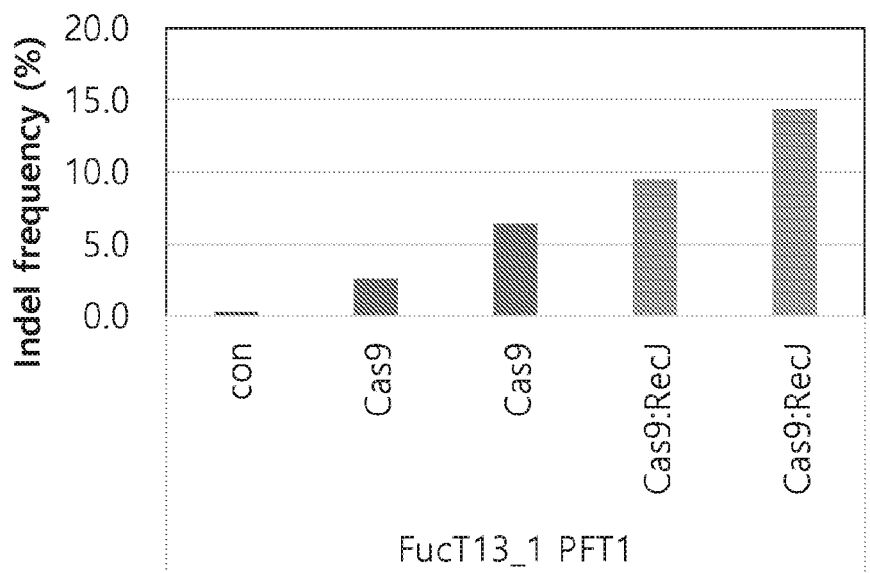
FIG. 136

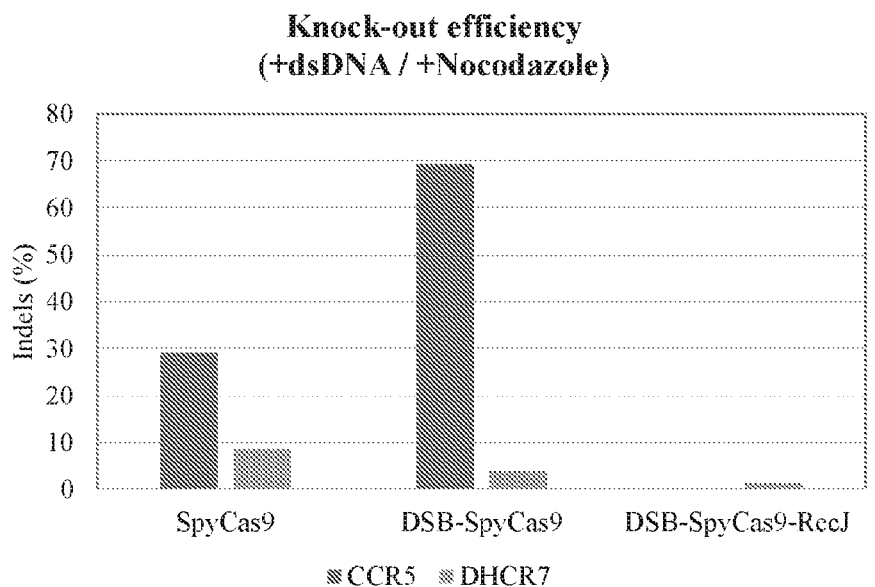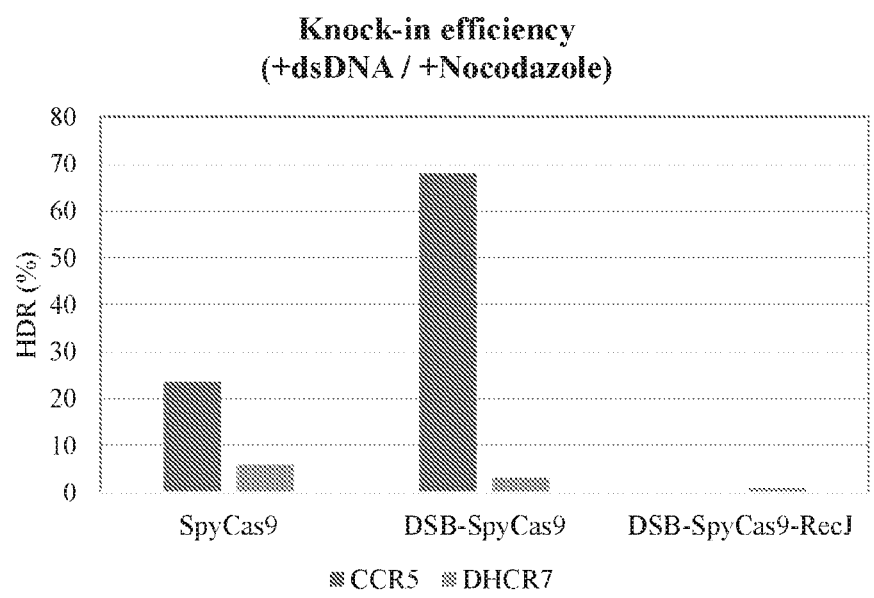
FIG. 139

CHIMERIC GENOME ENGINEERING MOLECULES AND METHODS

RELATED APPLICATIONS

The present application is a 371 of International Application No. PCT/IB2018/001581, filed Dec. 21, 2018, which claims the benefit of priority to U.S. Provisional No. 62/609,727 filed Dec. 22, 2017, which is hereby incorporated by reference in its entirety, and U.S. Provisional No. 62/622,025 filed Jan. 25, 2018, which is hereby incorporated by reference in its entirety.

SEQUENCE LISTING

The instant application contains a Sequence Listing which has been submitted electronically in ASCII format and is hereby incorporated by reference in its entirety. Said ASCII copy, created on Oct. 28, 2020, is named 53470_701_831_SL.txt and is 719,493 bytes in size.

BACKGROUND

Genome editing tools such as CRISPR/Cas systems can aid development of human therapeutics and breeding for agriculturally desirable traits. Double-stranded breaks generated by genome editing enzymes are repaired by cellular repair mechanisms such as non-homologous end joining (NHEJ) pathway and homology-dependent recombination mechanism. Of the NHEJ processes, error-free repair rather than error-prone repair pathways can dominate, which results in low efficiency of mutagenesis by the genome editing enzymes. Thus, there is a need for tools to increase error-prone repair processes in order to increase mutagenesis efficiency of genome editing enzymes.

SUMMARY

Described herein are polypeptides comprising a sequence-specific endonuclease fused in frame to a DNA modifying enzyme comprising a RecE domain. In some embodiments, the RecE domain exhibits at least 70% identity over at least 70% of its sequence to RecE. In some embodiments, the RecE domain exhibits at least 90% identity to RecE. In some embodiments, the RecE domain comprises a RecE sequence.

Described herein are polypeptides comprising a sequence-specific endonuclease fused in frame to a DNA modifying enzyme comprising a RecJ domain. In some embodiments, the RecJ domain exhibits at least 70% identity over at least 70% of its sequence to RecJ. In some embodiments, the RecJ domain exhibits at least 90% identity to RecJ. In some embodiments, the RecJ domain comprises a RecJ sequence.

Described herein are polypeptides comprising a sequence-specific endonuclease fused in frame to a DNA modifying enzyme comprising a RecBCD domain. In some embodiments, the RecBCD domain exhibits at least 70% identity over at least 70% of its sequence to RecBCD. In some embodiments, the RecBCD domain exhibits at least 90% identity to RecBCD. In some embodiments, the RecBCD domain comprises a RecBCD sequence.

Described herein are polypeptides comprising a sequence-specific endonuclease fused in frame to a DNA modifying enzyme comprising a Mungbean nuclease domain. In some embodiments, the Mungbean nuclease domain exhibits at least 70% identity over at least 70% of its sequence to Mungbean nuclease. In some embodiments, the Mungbean nuclease domain exhibits at least 90% identity to Mungbean nuclease. In some embodiments, the Mungbean nuclease domain comprises a Mungbean nuclease sequence.

Described herein are polypeptides comprising a sequence-specific endonuclease fused in frame to a DNA modifying enzyme comprising an ExoI domain. In some embodiments, the ExoI domain exhibits at least 70% identity over at least 70% of its sequence to ExoI. In some embodiments, the ExoI domain exhibits at least 90% identity to ExoI. In some embodiments, the ExoI domain comprises an ExoI sequence.

Described herein are polypeptides comprising a sequence-specific endonuclease fused in frame to a DNA modifying enzyme comprising an ExoIII domain. In some embodiments, the ExoIII domain exhibits at least 70% identity over at least 70% of its sequence to ExoIII. In some embodiments, the ExoIII domain exhibits at least 90% identity to ExoIII. In some embodiments, the ExoIII domain comprises an ExoIII sequence.

Described herein are polypeptides comprising a sequence-specific endonuclease fused in frame to a DNA modifying enzyme comprising an ExoVII domain. In some embodiments, the ExoVII domain exhibits at least 70% identity over at least 70% of its sequence to ExoVII. In some embodiments, the ExoVII domain exhibits at least 90% identity to ExoVII. In some embodiments, the ExoVII domain comprises an ExoVII sequence.

Described herein are polypeptides comprising a sequence-specific endonuclease fused in frame to a DNA binding protein (DBP). In some embodiments, the DBP binds single-stranded DNA. In some embodiments, the DBP binds double-stranded DNA.

Described herein are polypeptides comprising a sequence-specific endonuclease fused in frame to a terminal deoxyribonucleotidyl transferase (TdT). In some embodiments, the sequence-specific endonuclease comprises a region exhibiting 70% identity over at least 70% of its residues to a Cas9 domain. In some embodiments, the polypeptide or region exhibits at least 90% identity to a Cas9 domain. In some embodiments, the region is a Cas9 domain. In some embodiments, the Cas9 is SpCas9. In some embodiments, the Cas9 is SpyCas9. In some embodiments, the sequence-specific endonuclease comprises a region exhibiting 70% identity over at least 70% of its residues to a Cpf1 domain. In some embodiments, the polypeptide or region exhibits at least 90% identity to a Cpf1 domain. In some embodiments, the region is a Cpf1 domain. In some embodiments, the Cpf1 is FnCpf1. In some embodiments, the sequence-specific endonuclease comprises a TALEN nucleic acid recognition site. In some embodiments, the sequence-specific endonuclease comprises a zinc finger nucleic acid recognition site. In some embodiments, the polypeptide comprises a nuclear localization signal. In some embodiments, the polypeptide comprises an affinity tag.

In some embodiments, the DNA modifying enzyme generates a 3' OH overhang. In some embodiments, the DNA modifying enzyme exposes a recessed 3' OH. In some embodiments, the DNA modifying enzyme comprises cleaved end resection activity. In some embodiments, the polypeptide concurrently exhibits increased mutation efficiency and increased homologous recombination efficiency relative to wild type Cas9. In some embodiments, the increased activity is measured in at least one human cell genome or plant cell genome. In some embodiments, measured activity is assessed following a 2 hour incubation. In some embodiments, the measured activity is assessed following a 24 hour incubation. In some embodiments, the increased activity comprises an increased deletion rate. In some embodiments, the increased activity comprises an increased insertion rate. In some embodiments, the increased activity comprises an increased homologous recombination rate.

In some embodiments, the polypeptide is substantially free of bacterial cellular contaminant. In some embodiments, the polypeptide does not have an animal glycosylation pattern. In some embodiments, the polypeptide does not have a bacterial glycosylation pattern. In some embodiments, the polypeptide does not have a fungal glycosylation pattern. In some embodiments, the polypeptide is incubated in contact with a genome at a pH of at least 6. In some embodiments, the polypeptide is incubated in contact with a genome at a pH of at least 10.

Described herein are nucleic acids encoding a chimeric polypeptide. The chimeric polypeptide can be any of the polypeptides described herein. In some embodiments, the nucleic acid comprises an open reading frame that is at least partially codon optimized for expression in a plant target organism. In some embodiments, the nucleic acid comprises an open reading frame that is at least partially codon optimized for expression in a bacterial target organism. In some embodiments, the nucleic acid comprises an open reading frame that is at least partially codon optimized for expression in an animal target organism. In some embodiments, the nucleic acid comprises an open reading frame that is at least partially codon optimized for expression in a mammalian target organism. In some embodiments, the nucleic acid comprises an open reading frame that is at least partially codon optimized for expression in a human cell. In some embodiments, the nucleic acid comprises a 5' UTR at least partially optimized for expression in a plant target organism. In some embodiments, the nucleic acid comprises a 3' UTR at least partially optimized for expression in a plant target organism. In some embodiments, the nucleic acid comprises a 5' UTR at least partially optimized for expression in a bacterial target organism. In some embodiments, the nucleic acid comprises a 3' UTR at least partially optimized for expression in a bacterial target organism. In some embodiments, the nucleic acid comprises a 5' UTR at least partially optimized for expression in an animal target organism. In some embodiments, the nucleic acid comprises a 3' UTR at least partially optimized for expression in an animal target organism. In some embodiments, the nucleic acid comprises a 5' UTR at least partially optimized for expression in a mammalian target organism. In some embodiments, the nucleic acid comprises a 3' UTR at least partially optimized for expression in a mammalian target organism.

In some embodiments, the nucleic acid is configured for transient expression in a plant cell.

In some embodiments, the nucleic acid is coated on at least one gold particle. In some embodiments, the nucleic acid is coated on at least one tungsten particle. In some embodiments, the nucleic acid is packaged into a viral expression vector. In some embodiments, the nucleic acid is configured for stable expression in a plant cell. In some embodiments, the nucleic acid is configured for *Agrobacterium* expression. In some embodiments, the nucleic acid is packaged into a bacterial transformation vector. In some embodiments, the nucleic acid is packaged into a viral transformation vector. In some embodiments, the nucleic acid is packaged into a transformation vector for nuclear transformation. In some embodiments, the nucleic acid is packaged into a transformation vector for organellar transformation. In some embodiments, the nucleic acid comprises plant viral promoter. In some embodiments, the nucleic acid comprises a 35S promoter. In some embodiments, the nucleic acid comprises an rbcS promoter. In some embodiments, the nucleic acid comprises a psbA promoter. In some embodiments, the nucleic acid comprises an ubiquitin promoter.

Described herein are methods of tagging a repaired chromosome, comprising contacting the chromosome to a composition comprising a polypeptide described herein, wherein the polypeptide comprises a terminal deoxyribonucleotidyl transferase (TdT) activity, and a labeled nucleic acid. In some embodiments, the labeled nucleic acid comprises a non-canonical base. In some embodiments, the non-canonical base comprises BrdU. In some embodiments, the method comprises isolating nucleic acids comprising the labeled nucleic acid.

Described herein are methods of concurrently increasing a CRISPR-directed mutation rate and homologous recombination rate, comprising contacting a chromosome to a composition comprising a polypeptide described herein, wherein the polypeptide yields an exposed 3' OH overhang at a cleavage site of the chromosome. In some embodiments, the method comprises contacting the chromosome to a 5'-3' exonuclease activity. In some embodiments, the method exhibits at least a 20% genome modification rate. In some embodiments, the contacting occurs at a pH of at least 6. In some embodiments, the contacting occurs at a pH of at least 10.

Described herein are methods, of modifying a plant genome, comprising transfecting a cell harboring the plant genome using a polypeptide described herein, culturing the cell, and recovering plant tissue comprising a modified plant genome. In some embodiments, the modified plant genome does not encode a protein glycosyl transferase.

Described herein are methods of modifying a plant genome, comprising transfecting a cell harboring the plant genome using a nucleic acid described herein, culturing the cell, and recovering plant tissue comprising a modified plant genome. In some embodiments, the modified plant genome does not encode a protein glycosyl transferase.

Described herein are compositions comprising a polypeptide having endonuclease activity, a mung bean nuclease domain and a DNA sequence specificity domain.

The present disclosure provides methods of targeting a single locus for mutagenesis, said methods comprising selecting a locus for mutagenesis, contacting a genomic sample comprising the locus to an enzyme comprising an exonuclease domain and a programmable endonuclease domain that binds to the locus, sequencing across the locus, and sequencing a substantial portion of the genomic sample aside from the locus. In some embodiments, said selecting comprises identifying a unique segment of at least 10 bases in the genomic sample. In some embodiments, said contacting occurs in vivo. In some embodiments, said contacting comprises transfecting a cell using a vector encoding the enzyme. In some embodiments, said contacting comprises bombarding a cell using a nucleic acid encoding the enzyme. In some embodiments, bombarding comprises contacting to at least one gold particle. In some embodiments, bombarding comprises contacting to at least one tungsten particle. In some embodiments, said contacting comprises vacuum infiltration. In some embodiments, said contacting comprises *Agrobacterium*-mediated transformation. In some embodiments, said contacting comprises stable transformation. In some embodiments, said contacting comprises transient expression. In some embodiments, said exonuclease domain comprises an ExoI exonuclease activity. In some embodiments, said exonuclease domain comprises 5'-3' overhang exonuclease activity. In some embodiments, said exonuclease domain comprises double-stranded nucleic acid exonuclease activity. In some embodiments, said exonuclease domain does not exhibit single stranded nucleic acid exonuclease activity. In some embodiments, sequencing across the locus comprises observing a mutation relative to the locus prior to contacting. In some embodiments, sequencing across the locus comprises observing a deletion relative to the locus prior to contacting. In some embodiments, sequencing a substantial portion of the genomic sample aside from the locus comprises sequencing at least 1% of a genome copy of the genomic sample. In some embodiments, sequencing a substantial portion of the genomic sample aside from the locus comprises sequencing at least 5% of a genome copy of the genomic sample. In some embodiments, sequencing a substantial portion of the genomic sample aside from the locus comprises sequencing at least 10% of a genome copy of the genomic sample. In some embodiments, sequencing a substantial portion of the genomic sample aside from the locus comprises sequencing at least 50% of a genome copy of the genomic sample. In some embodiments, said contacting occurs in vivo, and wherein said sequencing a substantial portion of the genomic sample aside from the locus is performed subsequent to at least one cell division subsequent to said contacting. In some embodiments, the method further comprises contacting the sample to a Zinc ion. In some embodiments, the method further comprises contacting the sample to a composition comprising Zinc sulfate. In some embodiments, the exonuclease domain and the programmable endonuclease domain are fused in frame as a chimeric polypeptide, wherein the chimeric polypeptide exhibits enhanced on target mutagenesis compared to the sequence specific endonuclease and wherein the peptide exhibits the same or lower off target mutagenesis compared to the sequence specific endonuclease when unfused.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some understanding of the features and advantages of the present invention will be obtained by reference to the following detailed description that sets forth illustrative embodiments.

The present data disclosed in the figures below describe particular enzymes, which are explicitly recited. However, one of skill understands that these results may be generalized to a number of Cas protein fusions, both recited and not recited, but known, to those of skill.

Figure 1:
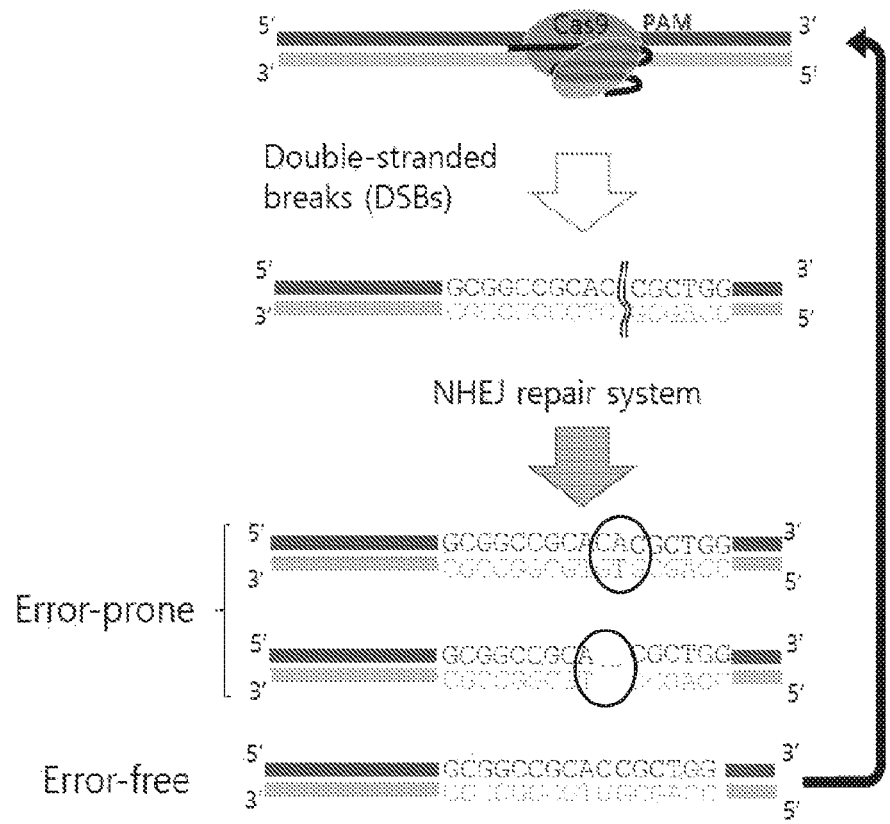

FIG. 1 illustrates role of non-homologous end joining (NHEJ) process in CRISPR/Cas mediated genome editing. Figure discloses SEQ ID NOS 114-121, respectively, in order of appearance.

Figure 2:
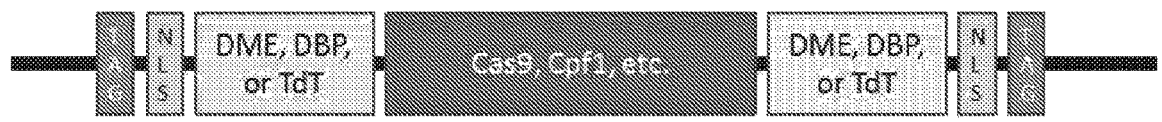

FIG. 2 illustrates chimeric polypeptide variants of the disclosure. Figure discloses SEQ ID NO: 78.

Figure 3:
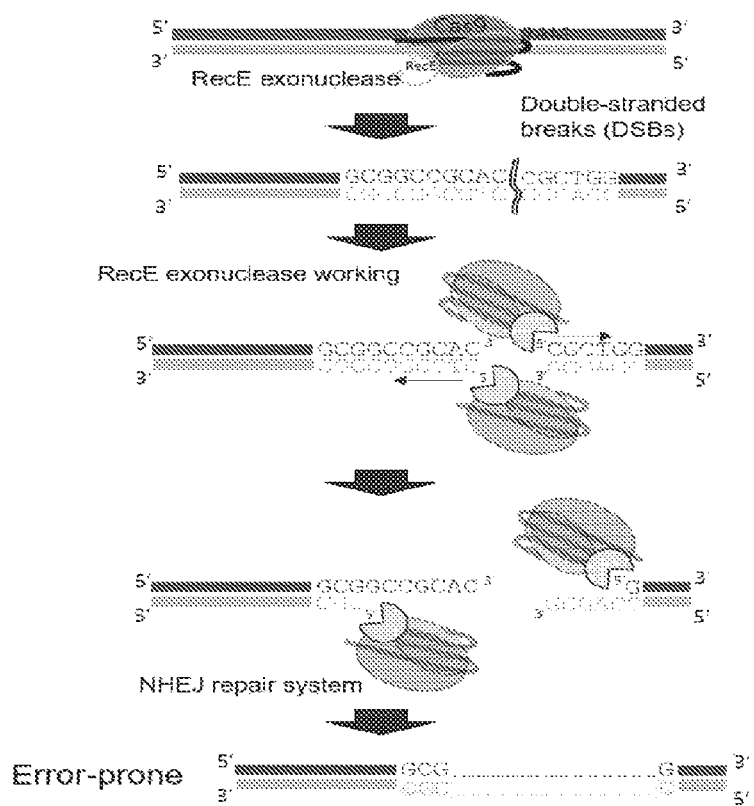

FIG. 3 depicts an illustrative method to increase efficiency of error-prone NHEJ using Cas9-RecE recombinant enzyme. Figure discloses SEQ ID NOS 114-115, 114-115 and 114, respectively, in order of appearance.

Figure 4:
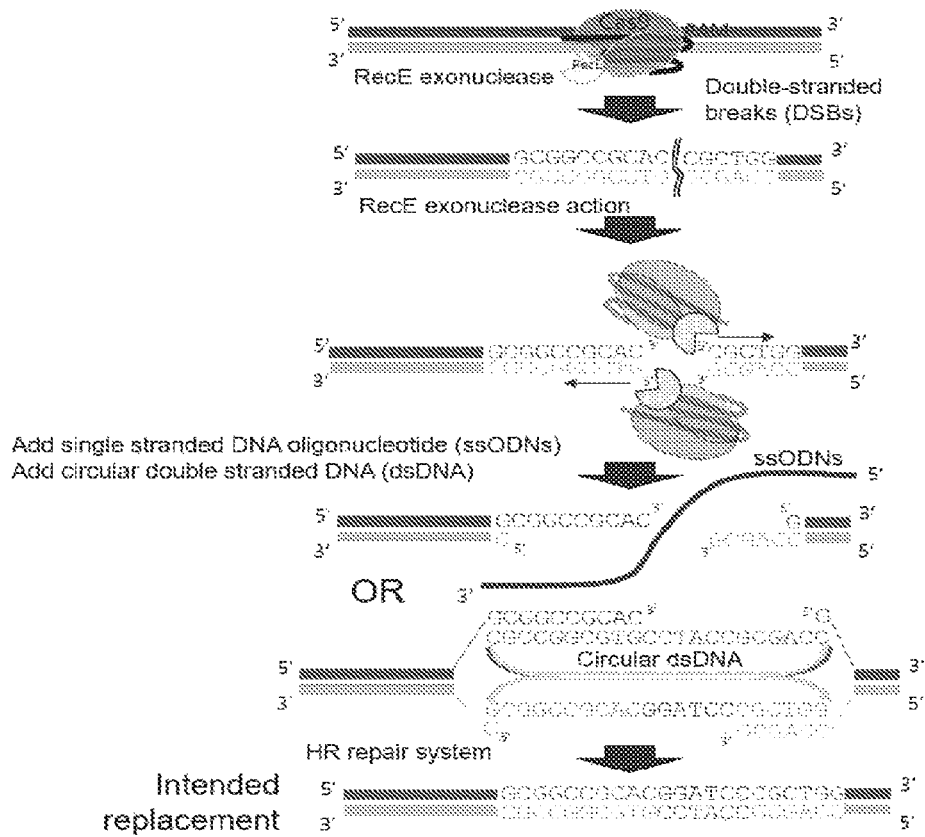

FIG. 4 depicts an illustrative method to increase homologous recombination efficiency using 3' overhang DNA generated by RecE activity. Figure discloses SEQ ID NOS 114-115, 114-115, 114, 114, 122-123, 123 and 122, respectively, in order of appearance.

Figure 5:
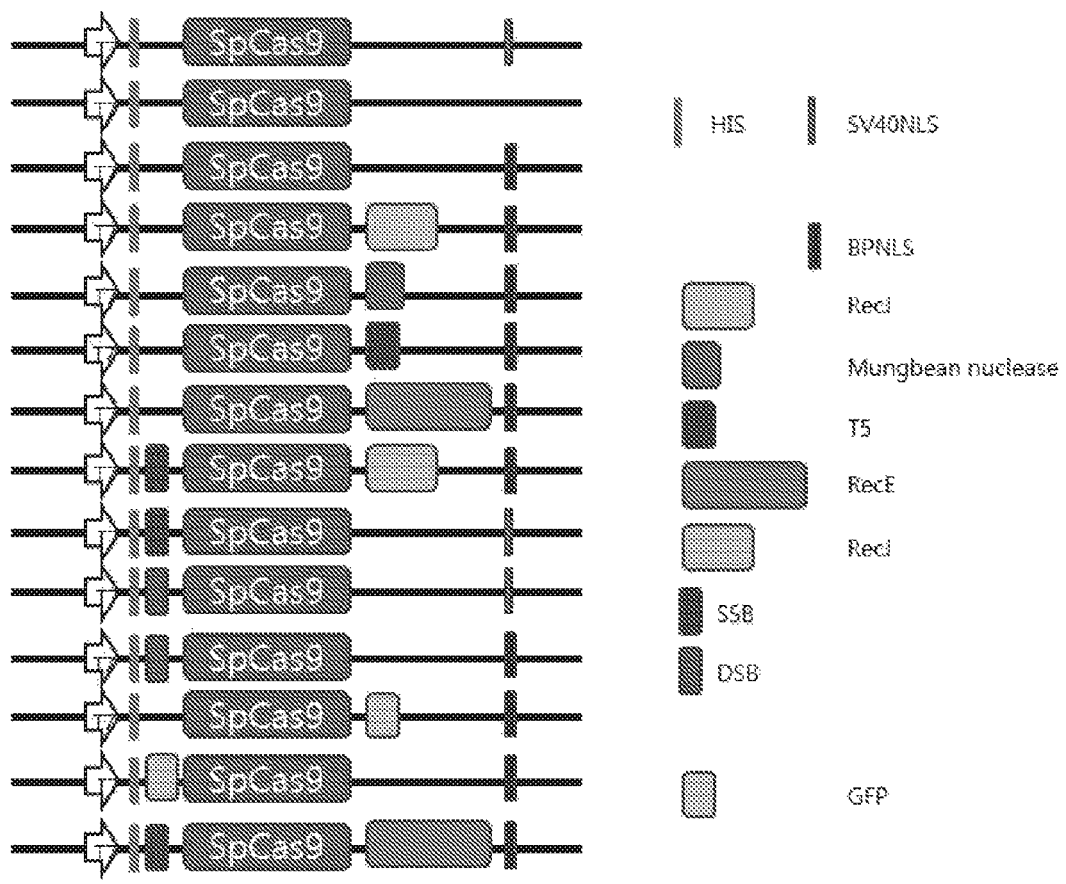

FIG. 5 shows a schematic of illustrative nucleic acid constructs encoding chimeric polypeptides to enhance Cas9 function.

Figure 6:
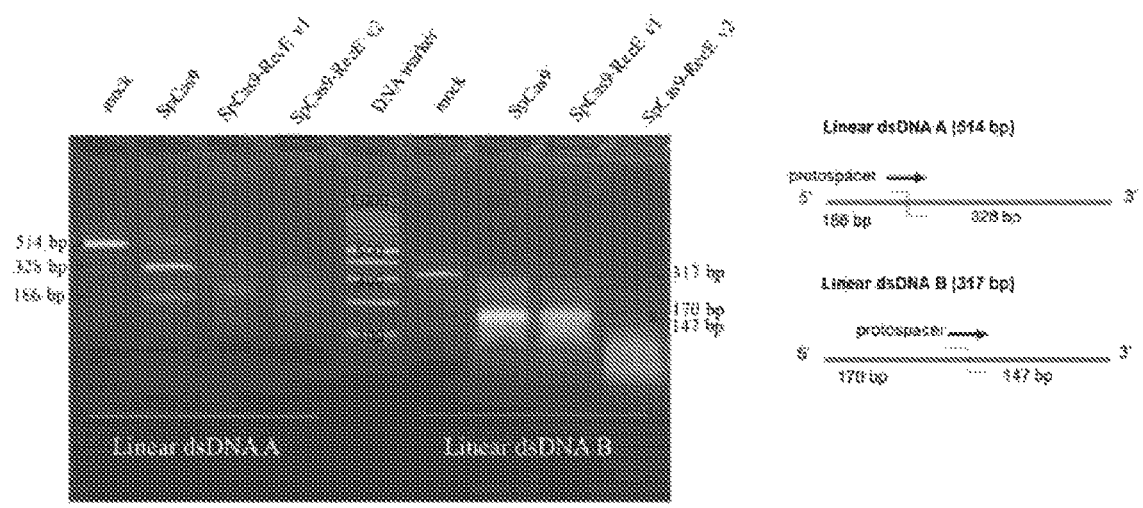
Figure 7:
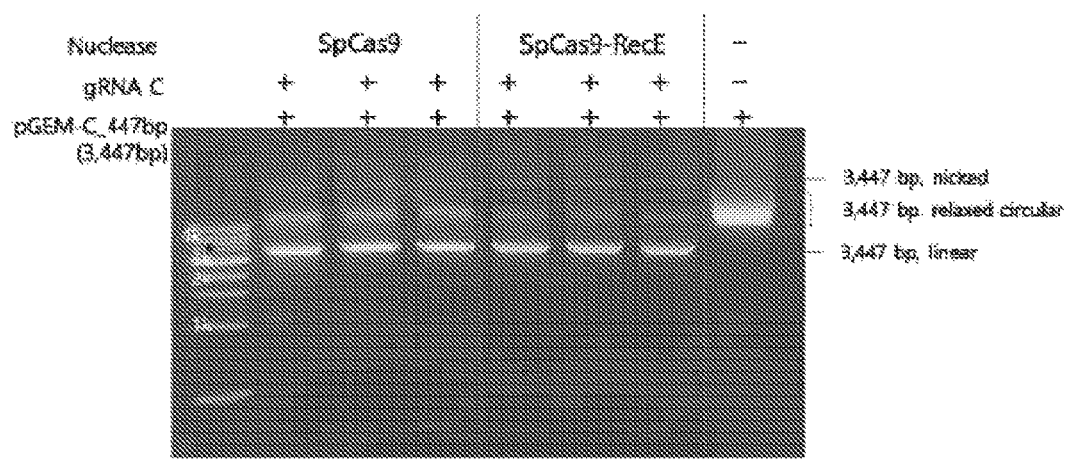

FIG. 6 illustrates cleavage of linear dsDNA by SpCas9 and SpCas9-RecE. Mock indicates that the sample is without gRNA/SpCas9 or gRNA/SpCas9-RecE. SpCas9 indicates only gRNA/SpCas9, and SpCas9-RecE v1 or v2 indicates 1-week old protein and fresh protein. Linear dsDNA A PCR product was 514 bp and linear dsDNA B PCR product was 317 bp. sgRNA A and sgRNA B were used, FIG. 7 illustrates cleavage of circular dsDNA by SpCas9 and SpCas9-RecE. DNA electrophoresis shows circular dsDNA cleavage by SpCas9 and SpCas9-RecE. Plasmid dsDNA C was used for circular dsDNA templates, and a sgRNA C was used to guide Cas9 into target site before PAM. Linear dsDNA mobility shifted slowly, which made it possible to show different size mobility between circular dsDNA of the same size and linear dsDNA. SpCas9 or SpCas9-RecE converted dsDNA to linear dsDNA by producing double stranded breaks on circular dsDNA. Arrows indicate different structure types of the same dsDNA.

Figure 8A:

FIG. 8A shows alignment of PCR product sequences generated by treating dsDNA with SpCas9 for 1 h followed by mungbean exonuclease treatment. Figure discloses all sequences as SEQ ID NO: 124, except the amino acid sequence as SEQ ID NO: 125 and the "C2_M13F" sequence as SEQ ID NO: 126.

Figure 8B:

FIG. 8B shows alignment of PCR product sequences generated by treating dsDNA with SpCas9-RecE for 1 h followed by mungbean exonuclease treatment. Figure discloses all sequences as SEQ ID NO: 127, except the amino acid sequence as SEQ ID NO: 128, the "E4_M13F" sequence as SEQ ID NO: 129, the "G2_M13F" sequence as SEQ ID NO: 130, the "H1_M13F" sequence as SEQ ID NO: 131 and the "H4_M13F" sequence as SEQ ID NO: 131.

Figure 9A:
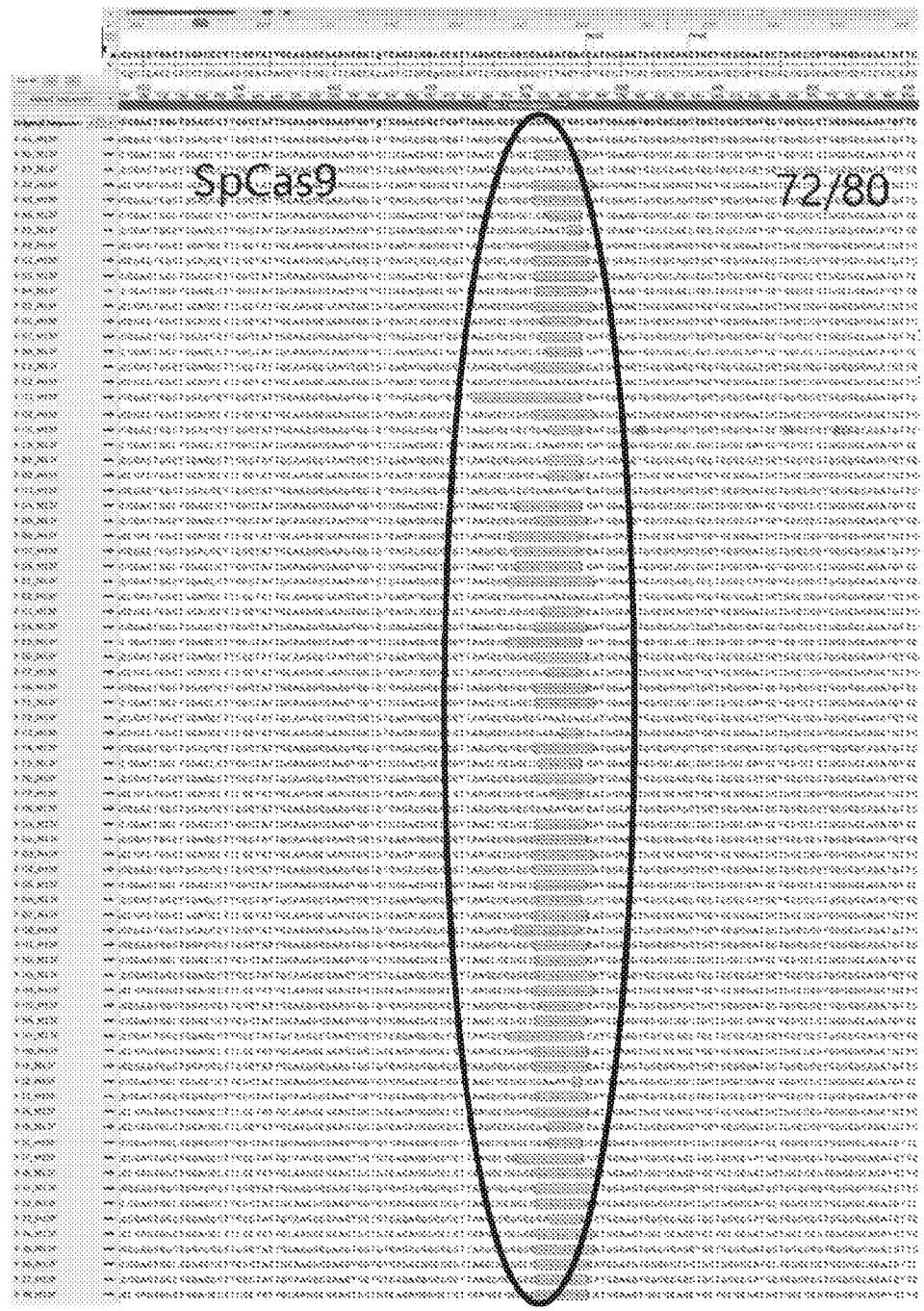

FIG. 9A shows alignment of PCR product sequences generated by treating dsDNA with SpCas9 for 3 h followed by mungbean exonuclease treatment. Figure discloses the first nucleotide sequence as SEQ ID NO: 132 and the amino acid sequence as SEQ ID NO: 133.

Figure 9B:
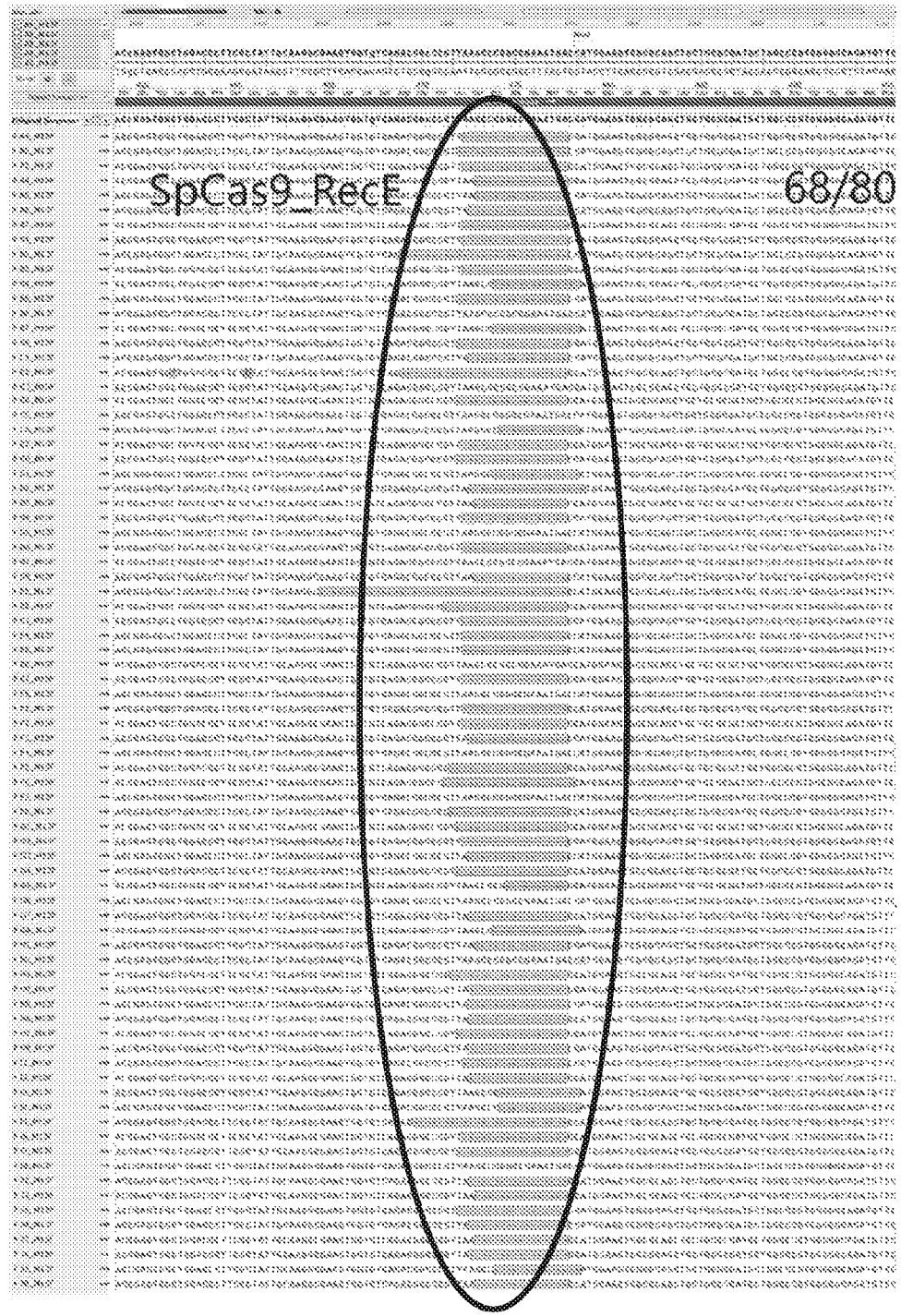

FIG. 9B shows alignment of PCR product sequences generated by treating dsDNA with SpCas9-RecE for 3 h followed by mungbean exonuclease treatment. Figure discloses the first nucleotide sequence as SEQ ID NO: 134 and the amino acid sequence as SEQ ID NO: 133.

Figure 10:
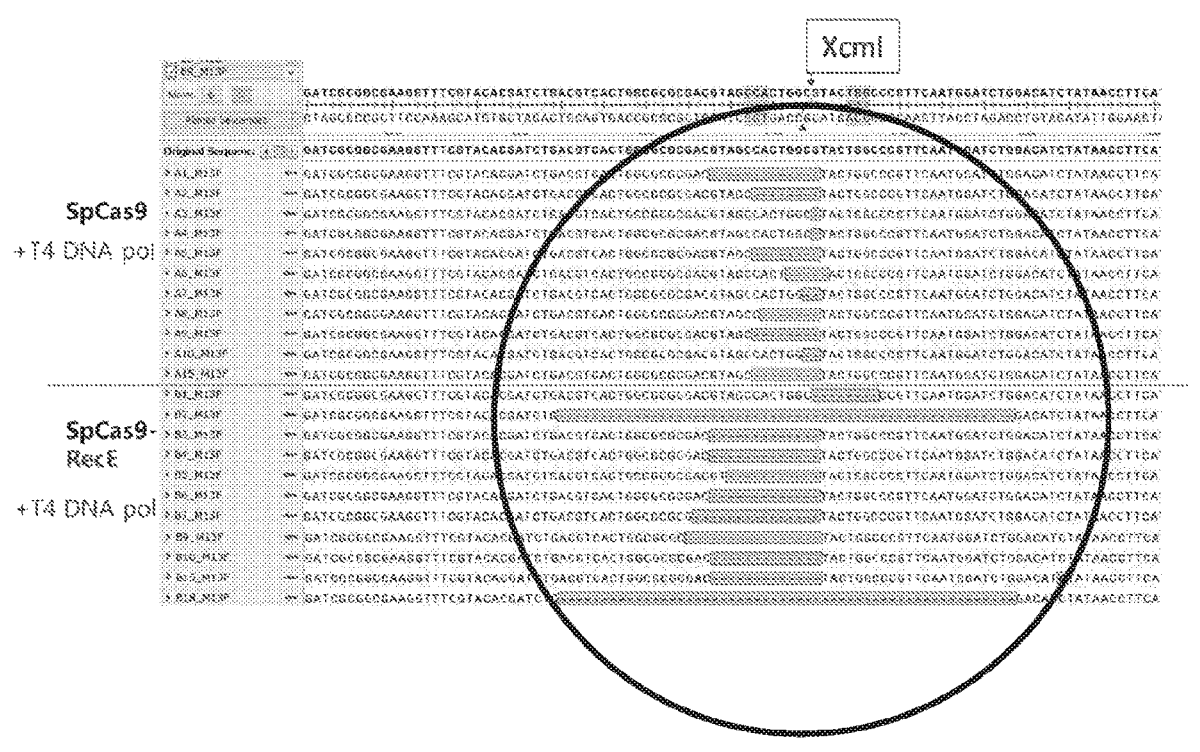

FIG. 10 shows alignment of PCR product sequences generated by treating dsDNA with SpCas9 and T4 DNA polymerase (top panel), and SpCas9-RecE and T4 DNA polymerase (lower panel). Figure discloses SEQ ID NOS 135, 135-138, 138, 137, 139-141, 137, 140, 137, 142-143, 136, 136, 144, 136, 145-146, 136, 147 and 143, respectively, in order of appearance.

Figure 11:
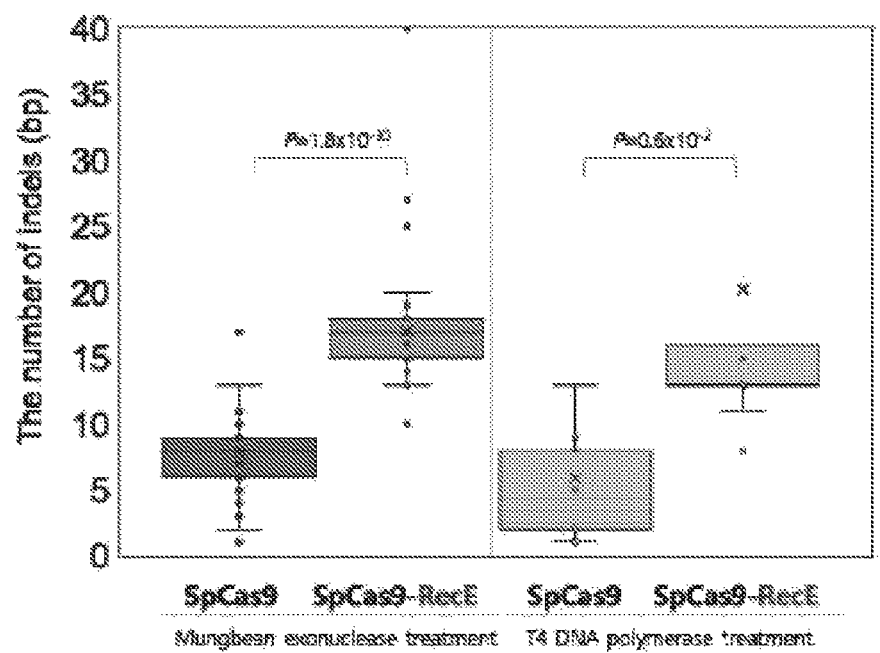

FIG. 11 illustrates a box plot for SpCas9 and SpCas9-RecE under mungbean exonuclease and T4 DNA polymerase treatment.

Figure 12A:
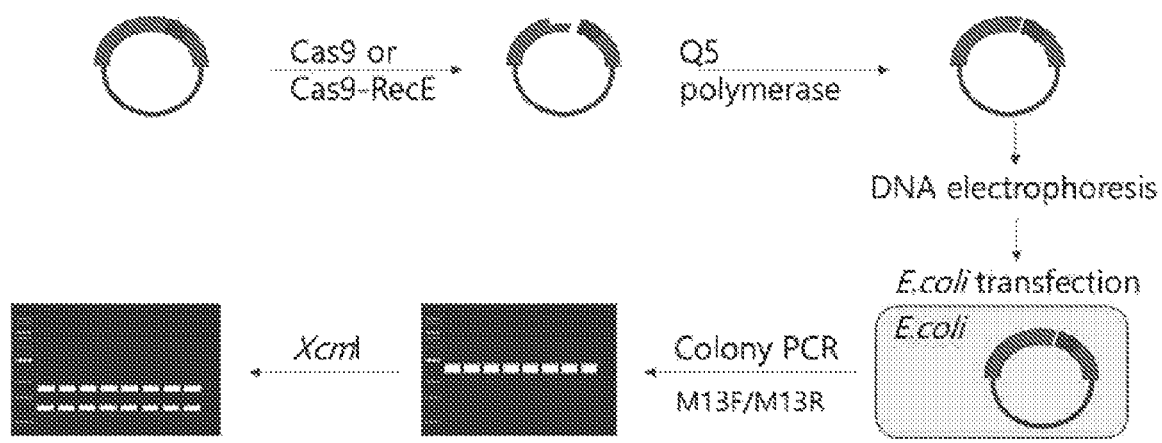

FIG. 12A shows a schematic diagram for an in vitro cleavage assay with SpCas9 or SpCas9-RecE. Shown is processing and analysis of a plasmid harboring an insert adjacent to a SpCas9 cleavage site.

Figure 12B:
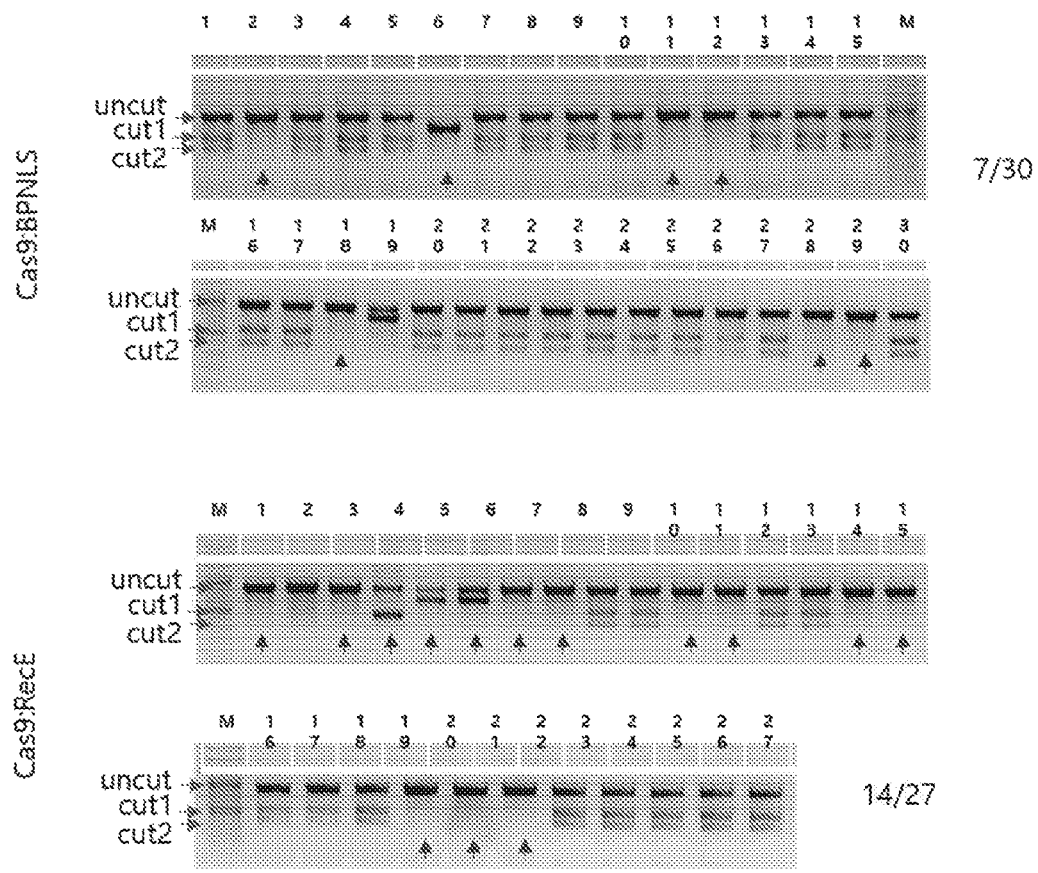

FIG. 12B illustrates results of the assay using DNA electrophoresis.

Figure 13:
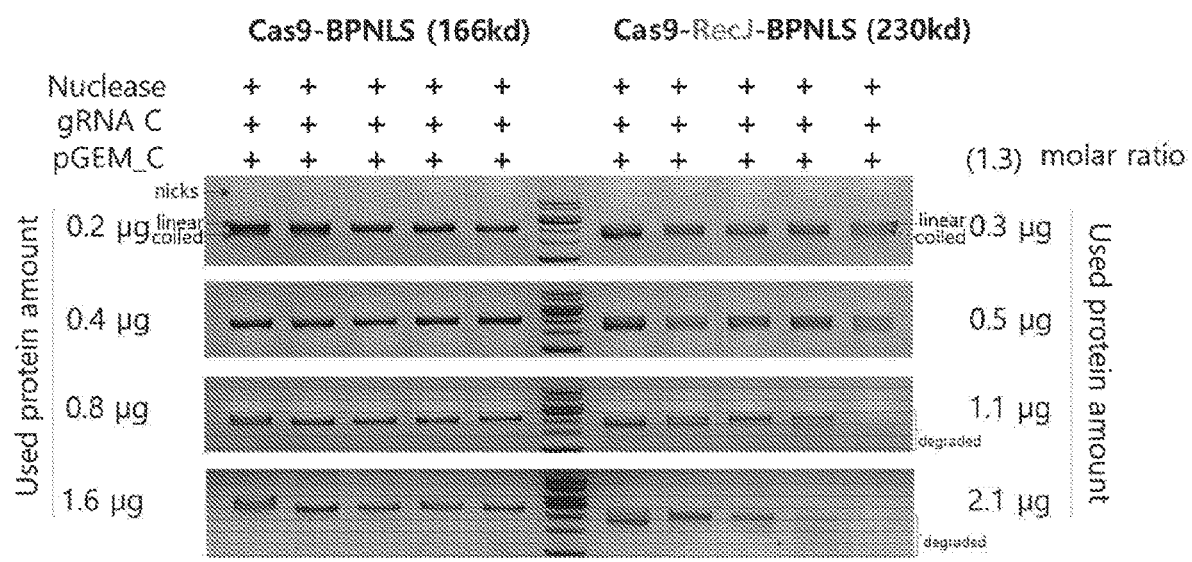

FIG. 13 illustrates results of an in vitro cleavage assay on circular dsDNA with Cas9 and Cas9-RecJ exonuclease.

Figure 14:
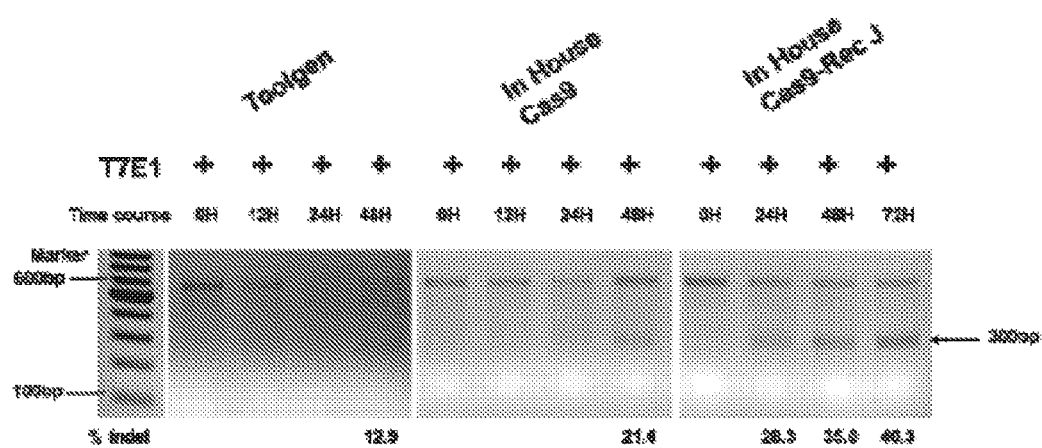

FIG. 14 illustrates time course of gene editing efficiency with different Cas9 variants.

Figure 15:
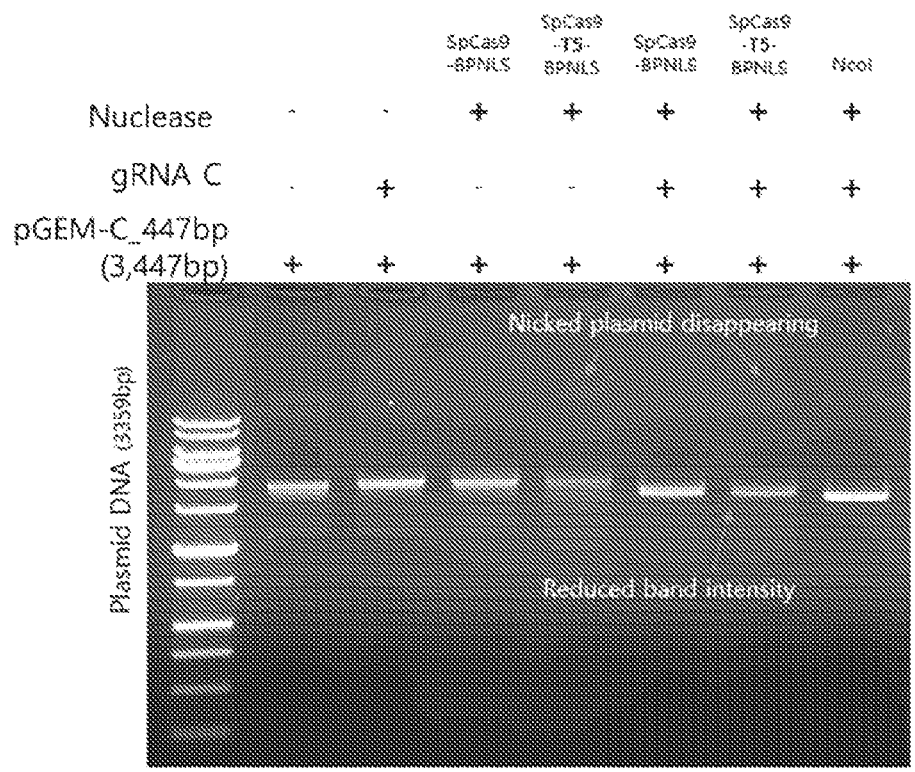

FIG. 15 illustrates cleavage of circular dsDNA by SpCas9 and SpCas9-T5 exonuclease.

Figure 16:
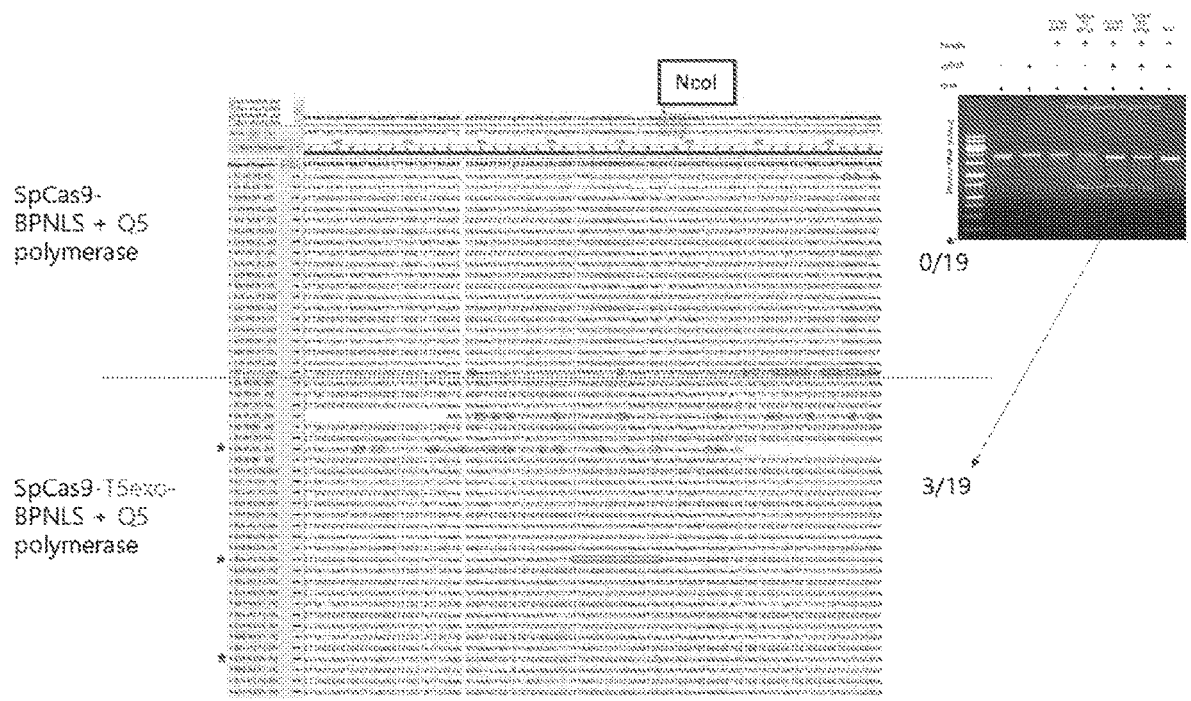

FIG. 16 illustrates alignment of PCR product sequences generated by treating dsDNA with SpCas9 and Q5 DNA polymerase (top panel), and SpCas9-T5 exonuclease and Q5 DNA polymerase (bottom panel). Figure discloses the first nucleotide sequence as SEQ ID NO: 148 and the amino acid sequence as SEQ ID NO: 67.

Figure 17:
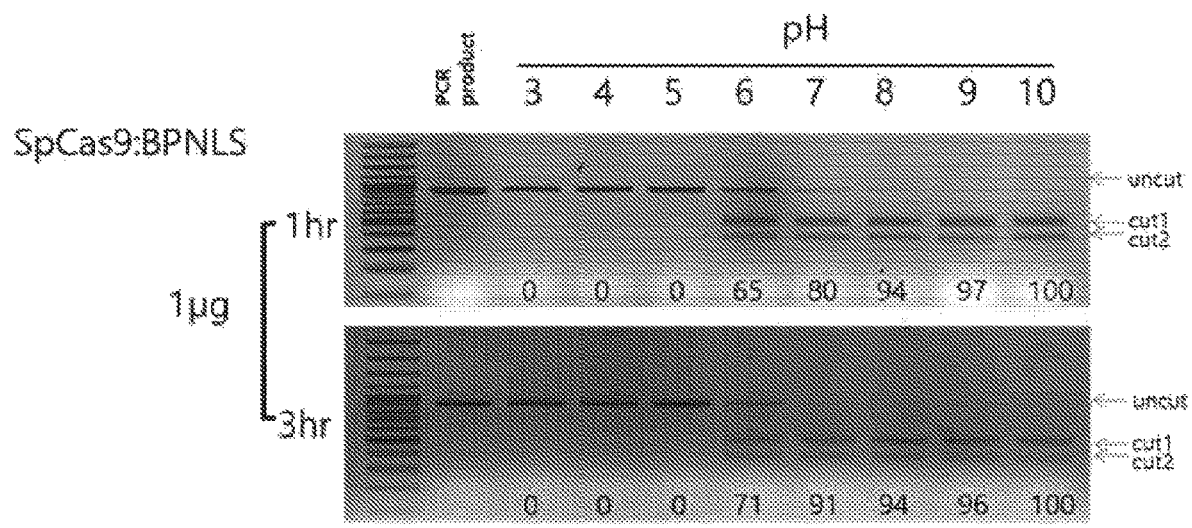

FIG. 17 illustrates activity of SpCas9 at various pHs (top panel). The bottom panel shows reaction conditions used for the assay.

Figure 18:
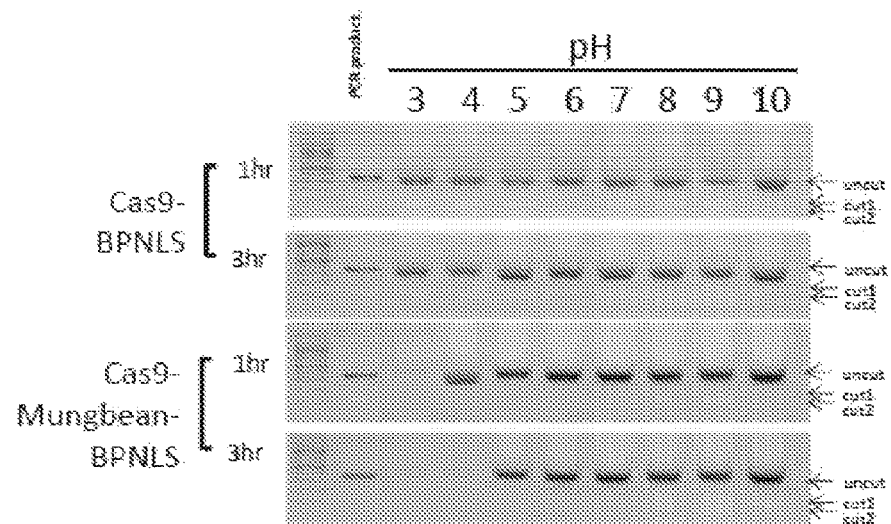

FIG. 18 illustrates activity of Cas9 and Cas9-mungbean exonuclease in the presence of $ZnSO_4$ at various pHs (top panel). The bottom panel shows reaction conditions used for the assay.

Figure 19:
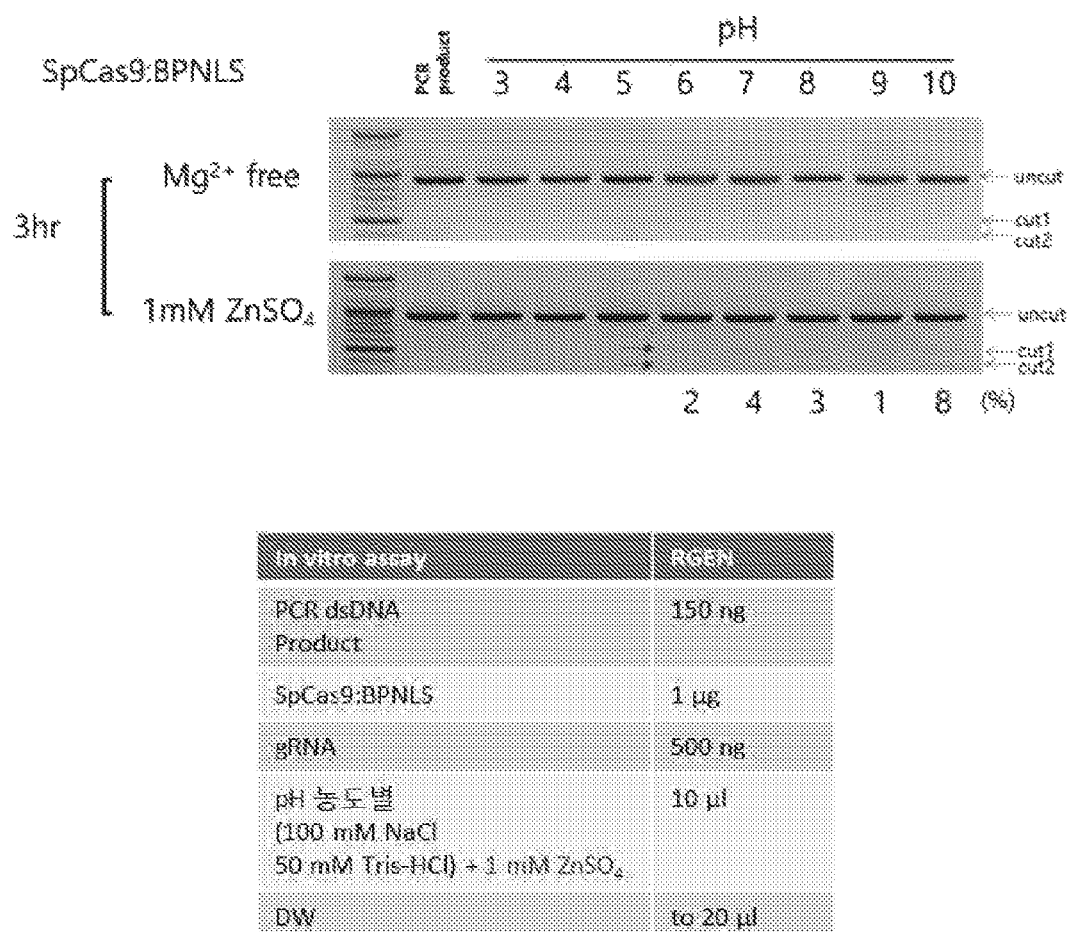

FIG. 19 illustrates SpCas9 activity in the absence of $Mg^{2+}$ and the presence of $ZnSO_4$. Zinc was supplied with 1 mM $ZnSO_4$ to replace $Mg^{2+}$ as a cofactor for SpCas9 in D reaction buffer.

Figure 20A:
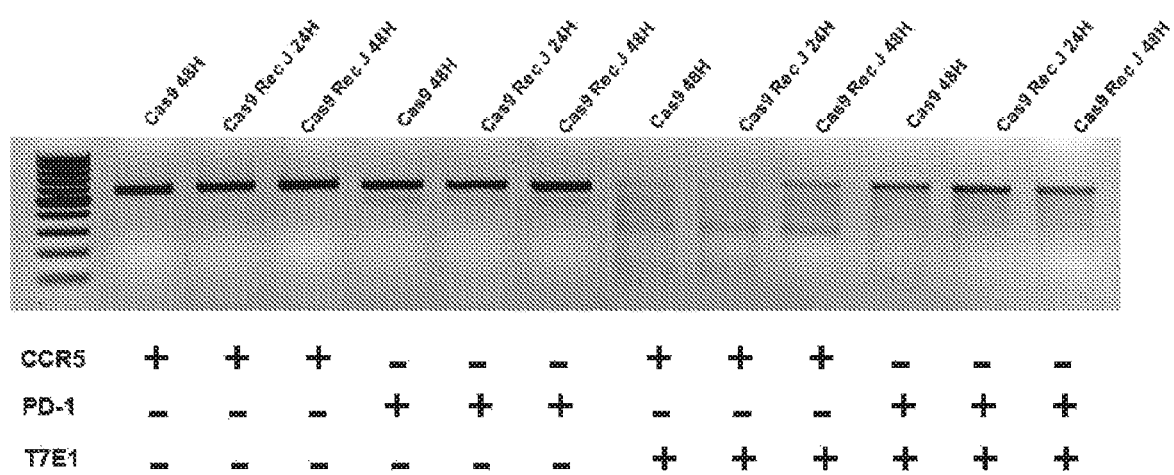

FIG. 20A illustrates the on-target activity of SpCas9 and SpCas9-RecJ with the PD-1 and CCR5 gene sequences in HEK293 cells.

Figure 20B:
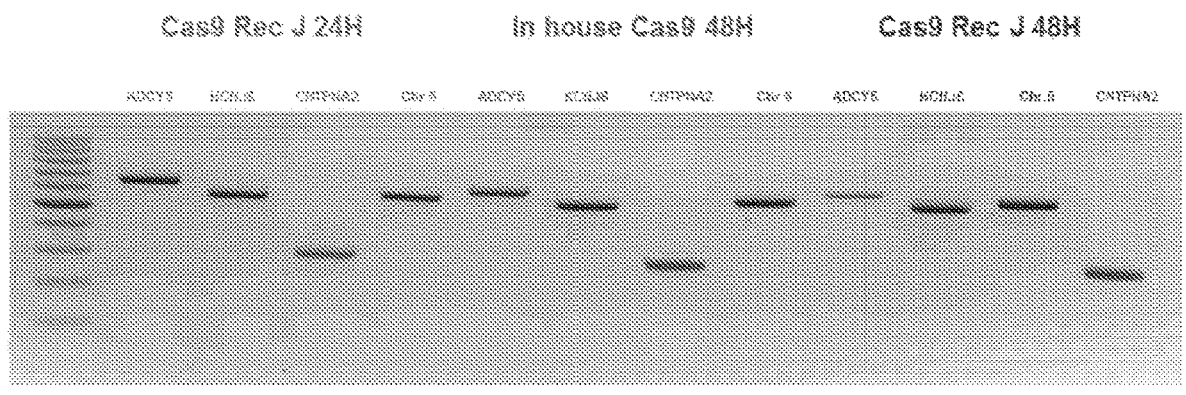

FIG. 20B shows the amplification of off-target genes that served as negative controls for the T7E1 assay.

Figure 20C:
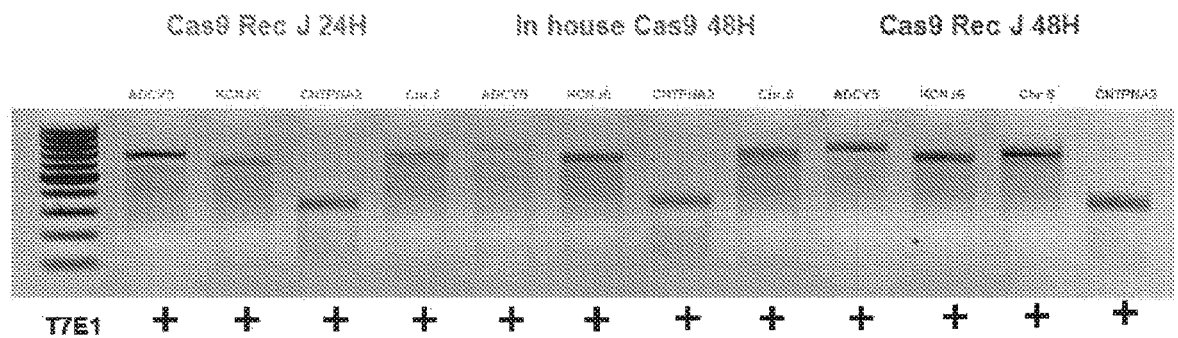

FIG. 20C illustrates the off-target effect for CCR5 as measured by in vitro cleavage of off-target genes.

Figure 21:
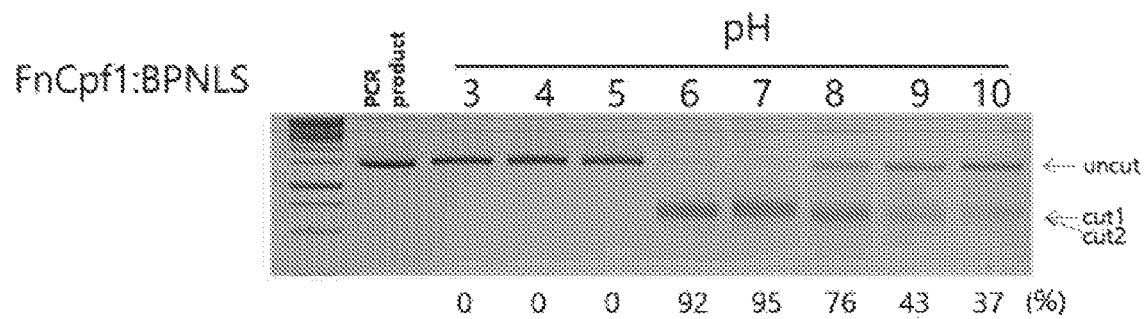

FIG. 21 illustrates pH range scanning for FnCpf1.

Figure 22:
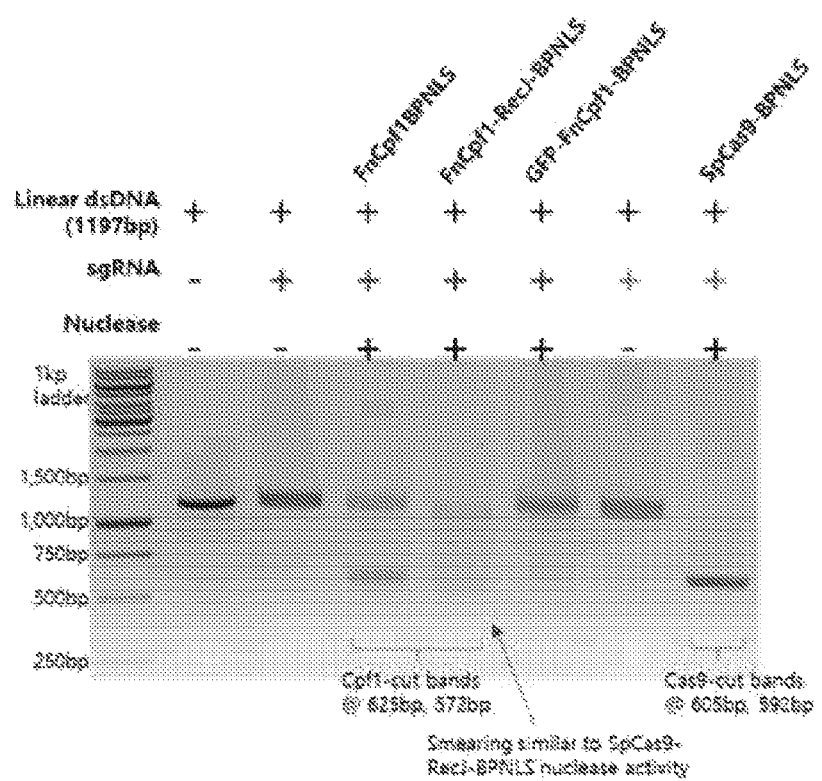

FIG. 22 shows results of an in vitro cleavage assay of linear dsDNA with FnCpf1, FnCpf1-RecJ, or SpCas9 exonuclease.

Figure 23:
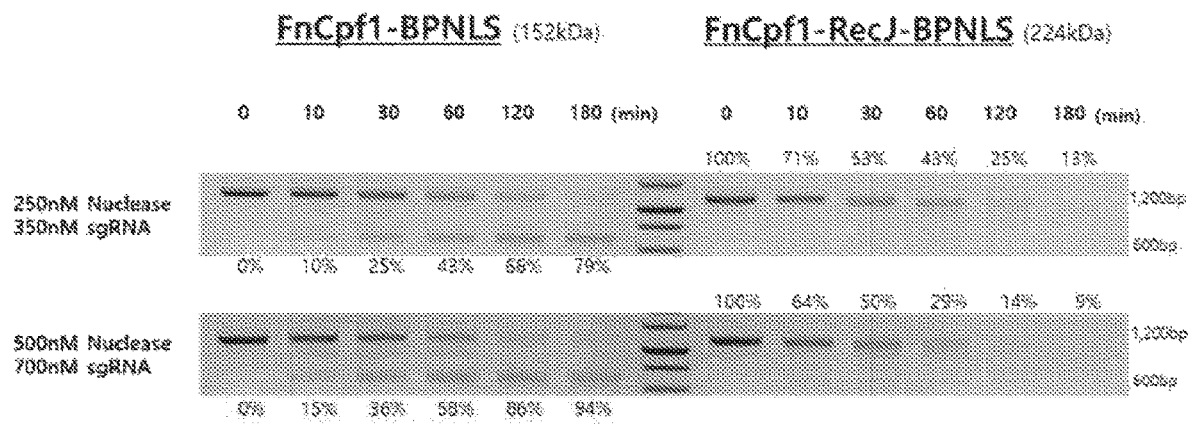

FIG. 23 shows results of an in vitro cleavage assay of linear dsDNA with FnCpf1 or FnCpf1-RecJ exonuclease.

FIG. 24 at top illustrates functional genomics with random mutagenesis and T-DNA tagging methods. At bottom, the figure shows T-DNA express: an Arabidopsis gene mapping tool.

Figure 25:
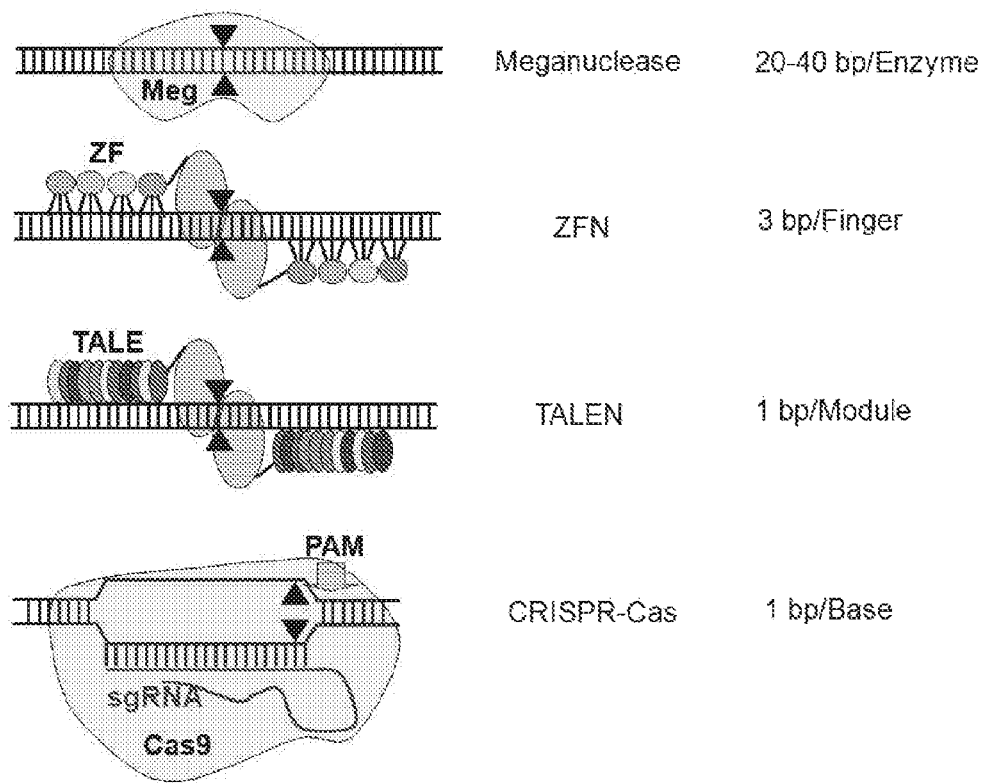

FIG. 25 illustrates evolution of site specific genome editing for ZFN, TALEN, and Cas9.

Figure 26:
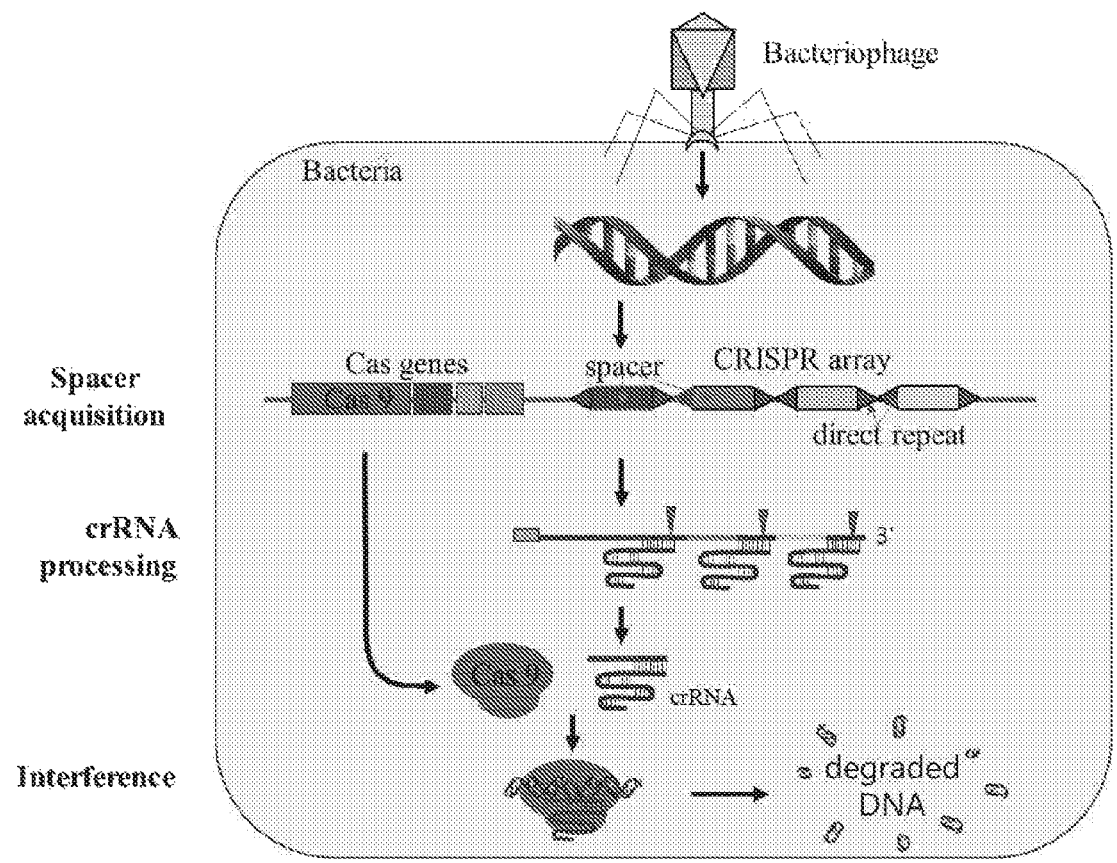

FIG. 26 illustrates a bacteriophage entering a bacterium and degradation of corresponding nucleic acids by Cas9.

Figure 27:
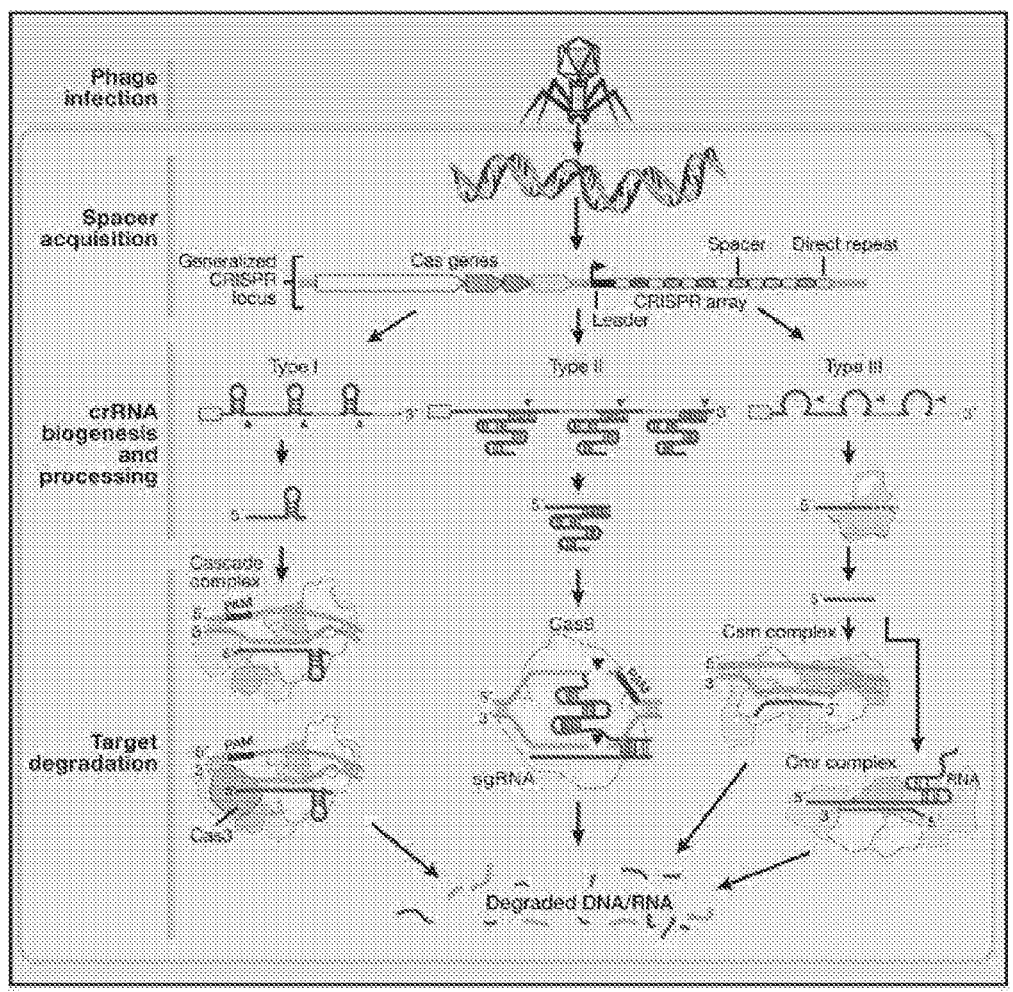

FIG. 27 illustrates types of CRISPR systems including single or multiple polypeptides of the effector proteins.

Figure 28:
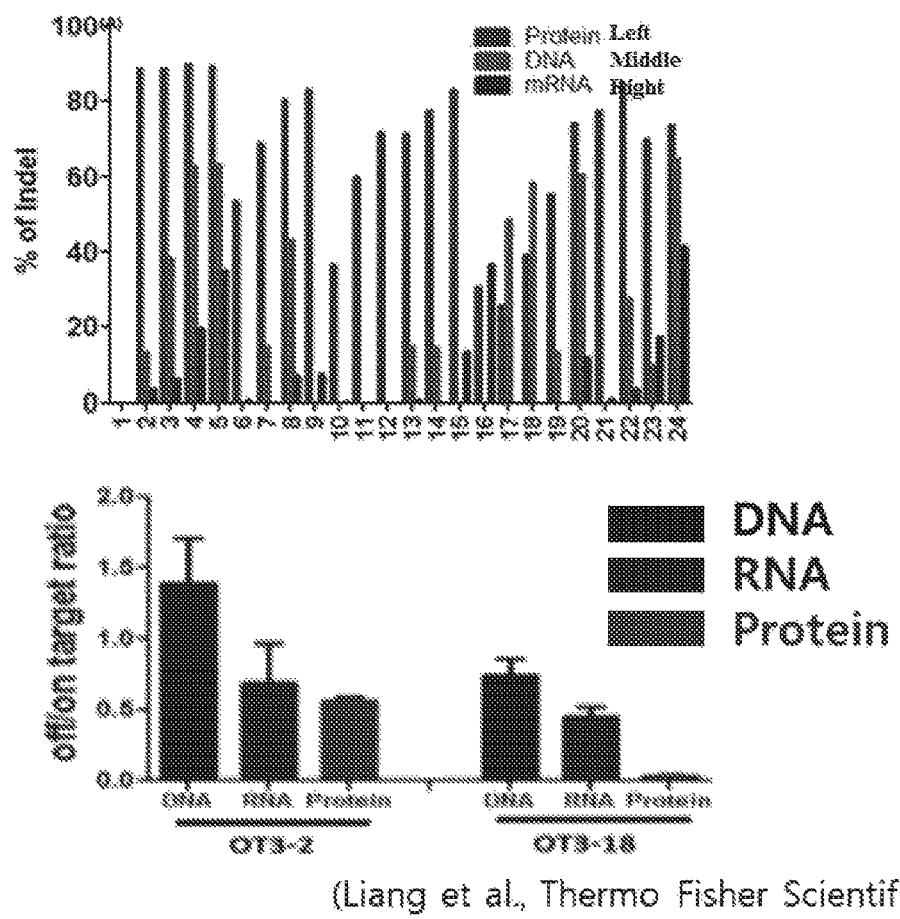

FIG. 28 illustrates ribonucleoprotein (RNP) and nucleic acids as well as advantages of RNP methods of DNA and RNA approaches.

Figure 29:
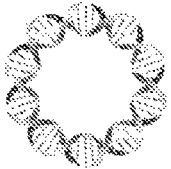

FIG. 29 illustrates CRISPR/Cas9 delivery methods including ribonucleoprotein (RNP) and nucleic acids.

FIG. 30 illustrates procedures to prepare CRISPR enzymes and purification of the CRISPR/Cas9 complex and Cas9 Plus.

FIG. 31 illustrates procedures to prepare CRISPR enzymes and sgRNA preparation and holoenzyme. Figure discloses SEQ ID NO: 149.

Figure 32:
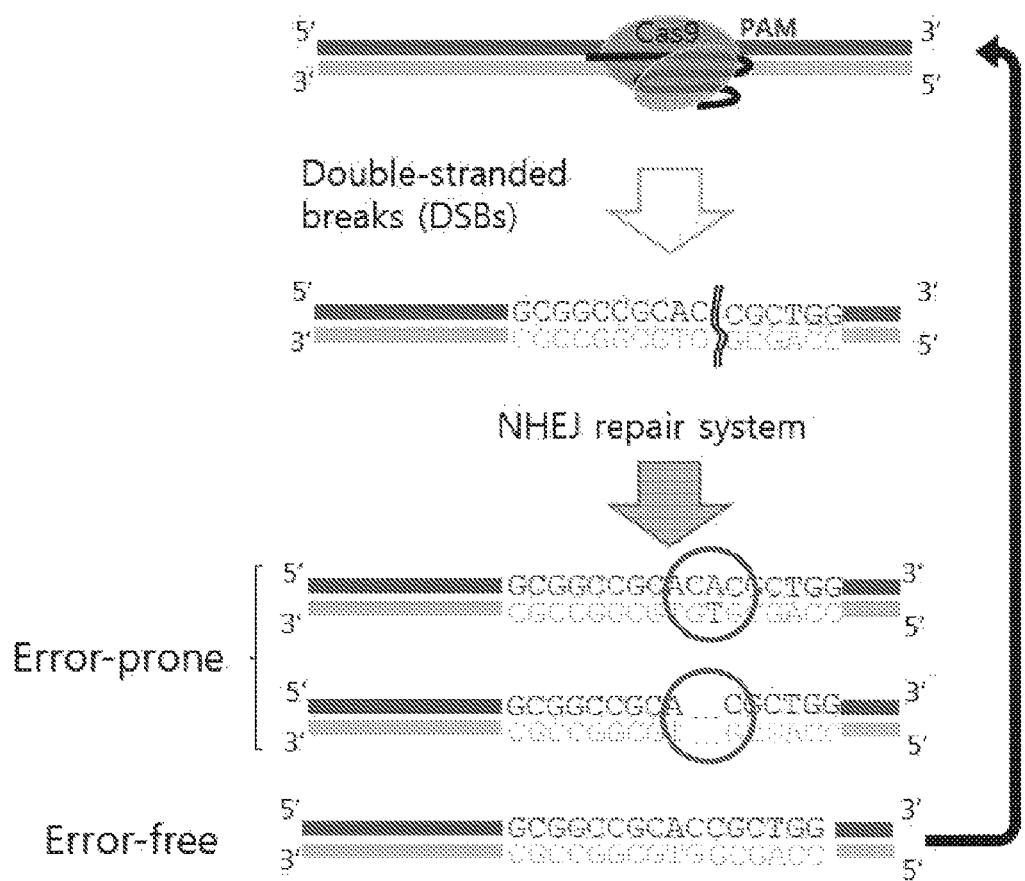

FIG. 32 illustrates needs for CRISPR PLUS including how off-target effects are reduced. Figure discloses SEQ ID NOS 114-121, respectively, in order of appearance.

FIG. 33 illustrates design of CRISPR PLUS and schematic of variants of CRISPR genome editing enzymes. Figures discloses SEQ ID NO: 78.

Figure 34:
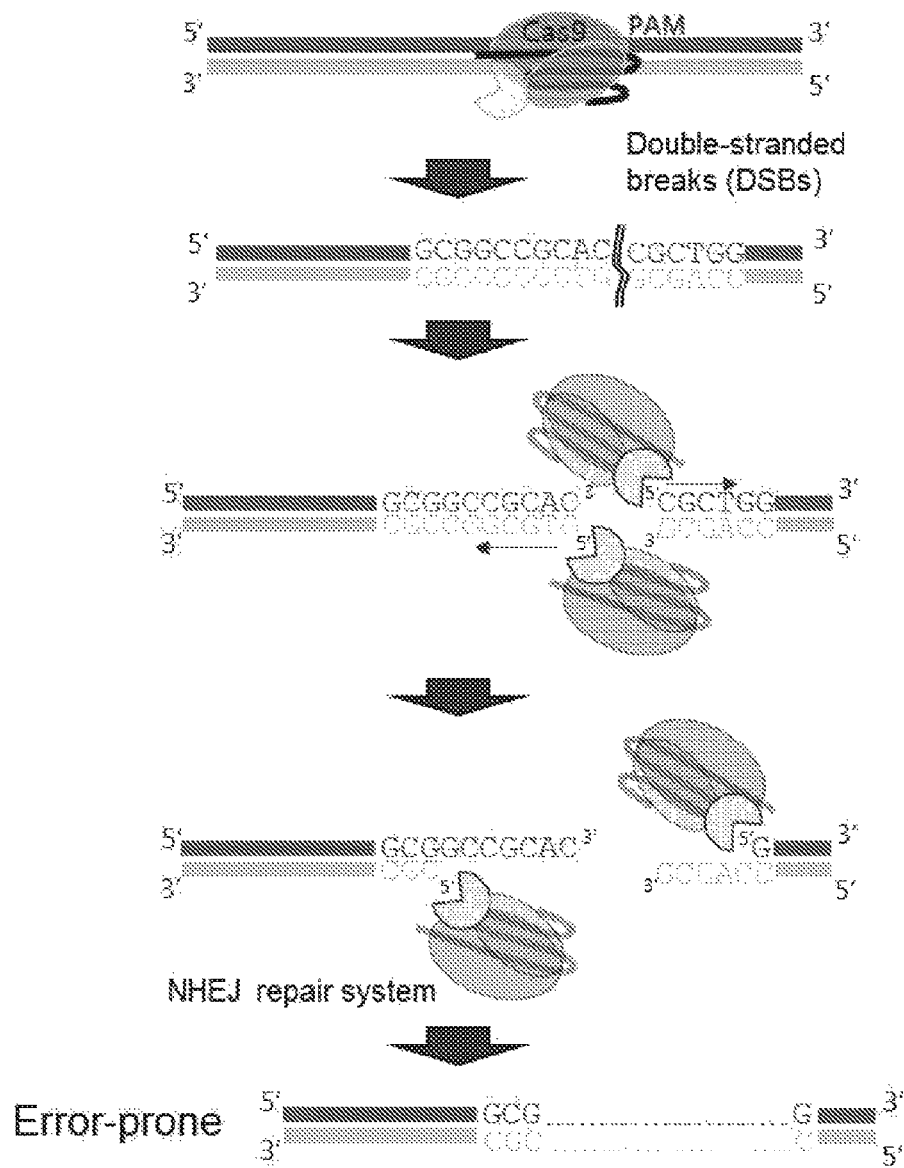

FIG. 34 illustrates design of CRISPR Plus including how to reduce off target effects. Figure discloses SEQ ID NOS 114-115, 114-115 and 114, respectively, in order of appearance.

FIG. 35 illustrates functional enhancements in human HEK293T cells and a comparison of T7E1 results.

Figure 36:
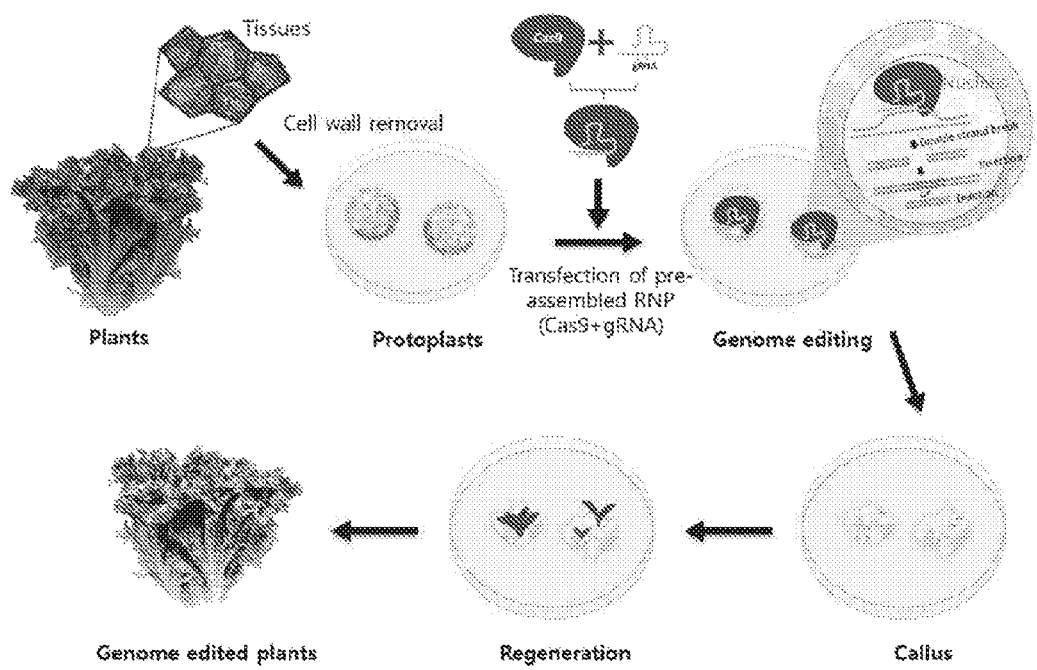

FIG. 36 illustrates scheme of DNA-free genome editing.

Figure 37:
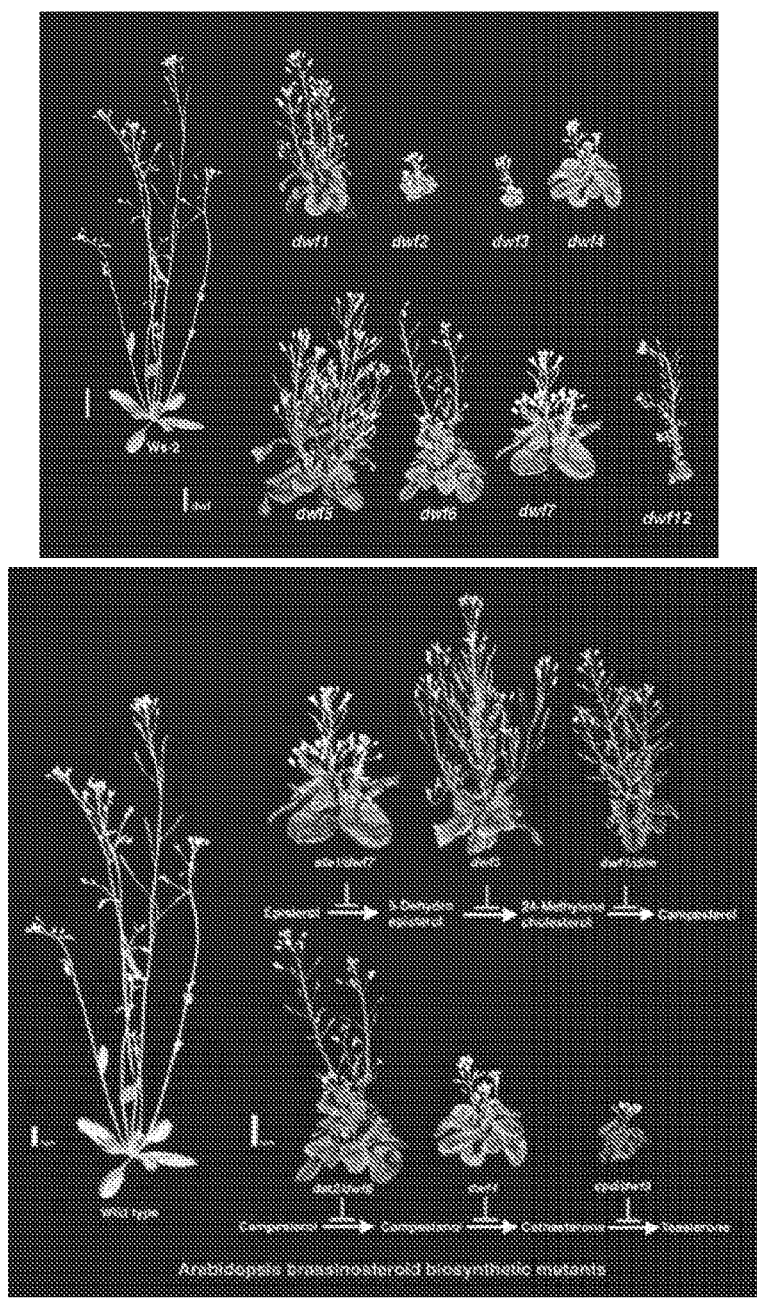

FIG. 37 illustrates example genes to editing including Arabidopsis brassinosteroid mutants.

Figure 38:
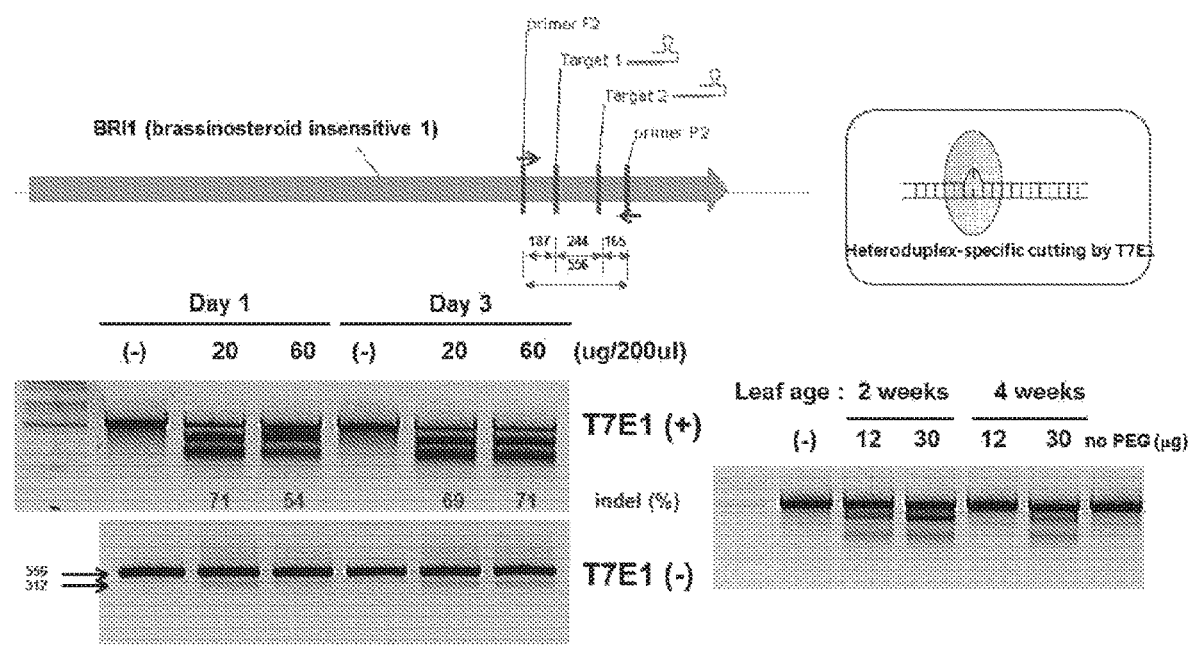

FIG. 38 illustrates a ribonucleoprotein (RNP) complex of Cas9-sgRNA entering and editing protoplasts.

Figure 39:
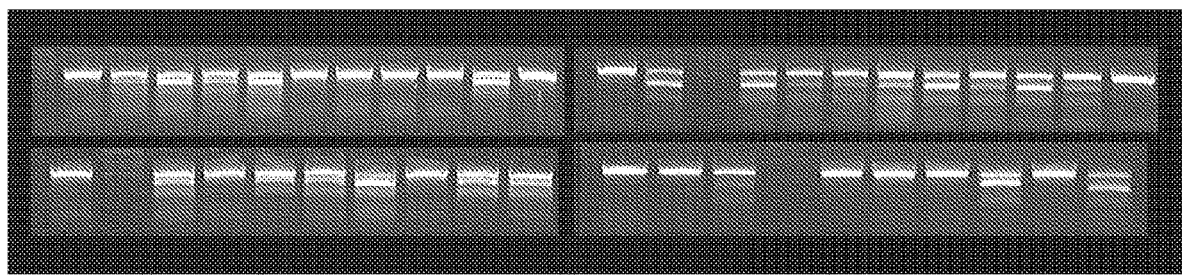

FIG. 39 illustrates a double target method used to delete the intervening DNA. Figure discloses SEQ ID NOS 150-151, 150 and 152-155, respectively, in order of appearance.

Figure 40:
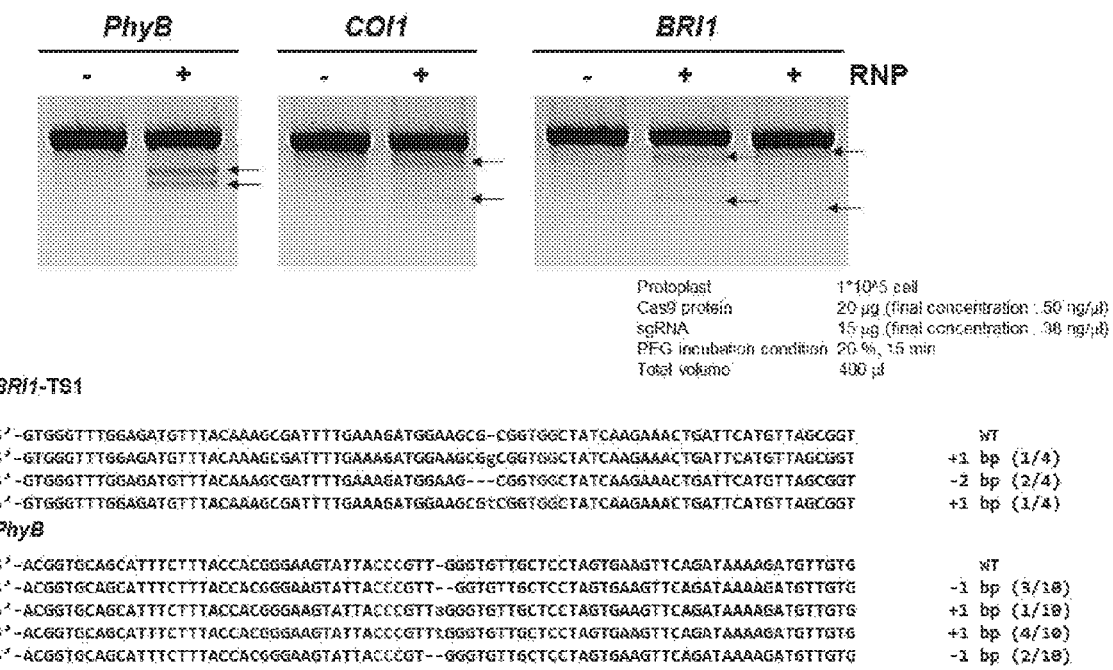

FIG. 40 illustrates that other loci of the Arabidopsis genomes are accessible. Figure discloses SEQ ID NOS 156-164, respectively, in order of appearance.

FIG. 41 illustrates that off-target effects are lower in Arabidopsis. Figure discloses SEQ ID NOS 165-180, respectively, in order of appearance.

Figure 42:
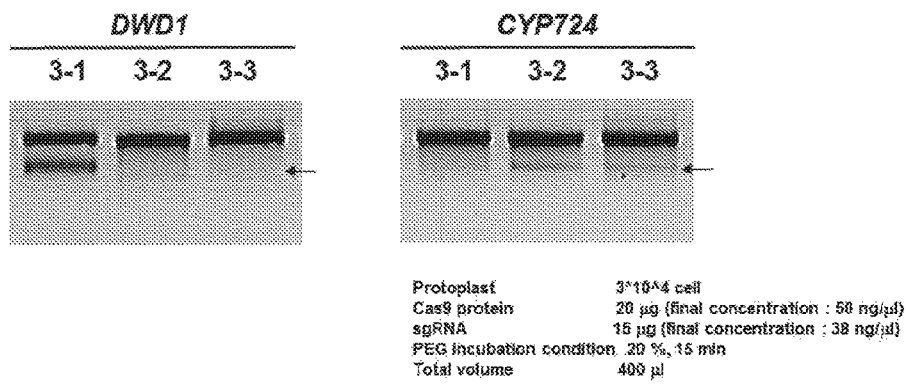

FIG. 42 illustrates assembled RNPs, which work for rice protoplasts. Figure discloses SEQ ID NOS 181-186, respectively, in order of appearance.

Figure 43:
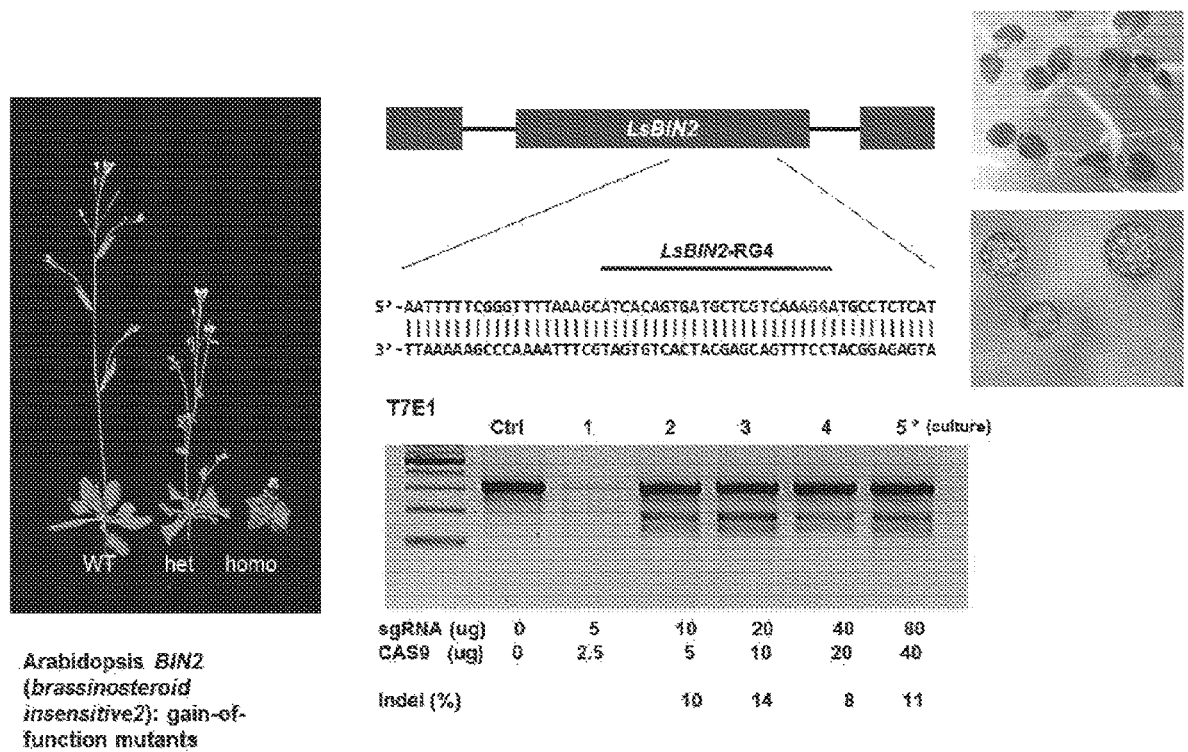

FIG. 43 illustrates that the Cas9-sgRNA complex works in lettuce. Figure discloses SEQ ID NO: 187.

Figure 44:
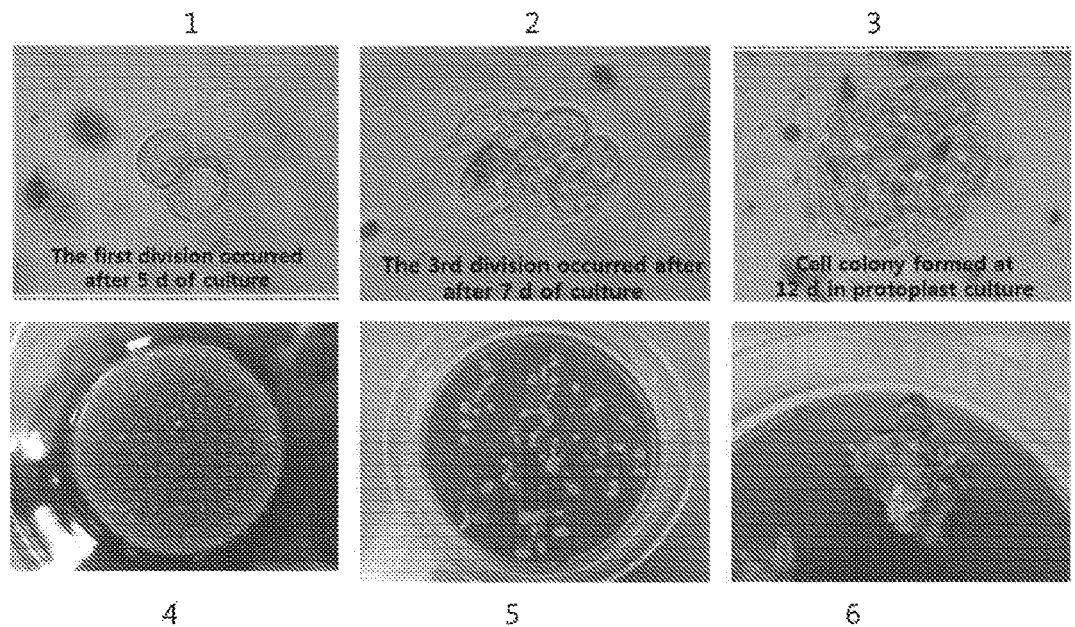

FIG. 44 illustrates RNP-mediated genome editing followed by lettuce plant regeneration.

Figure 45:
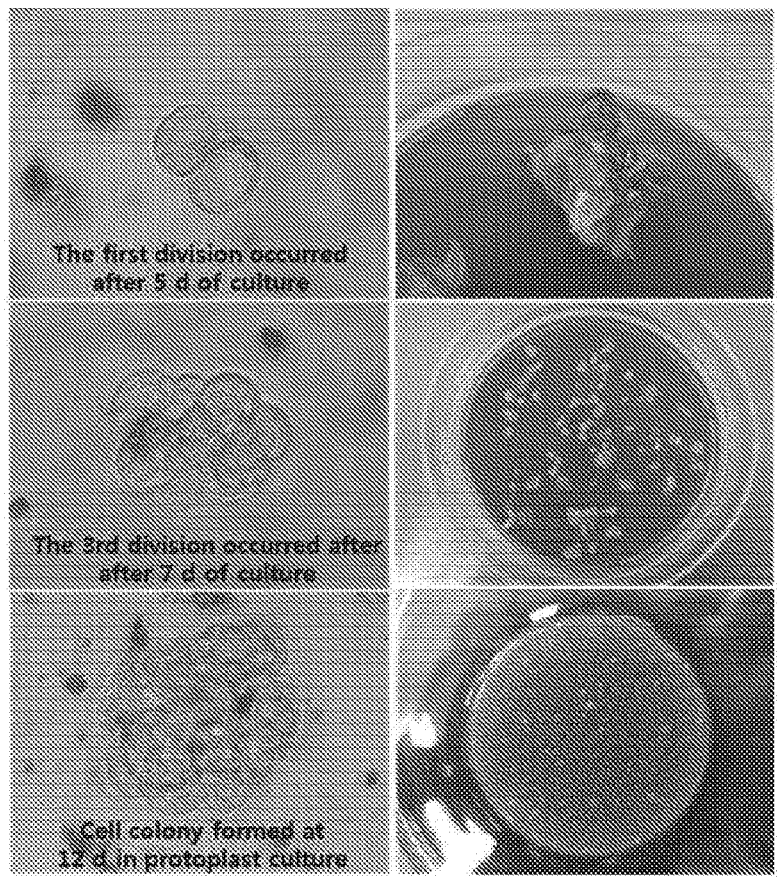

FIG. 45 illustrates regeneration of plantlets after gene editing (GE) in lettuce.

Figure 46:
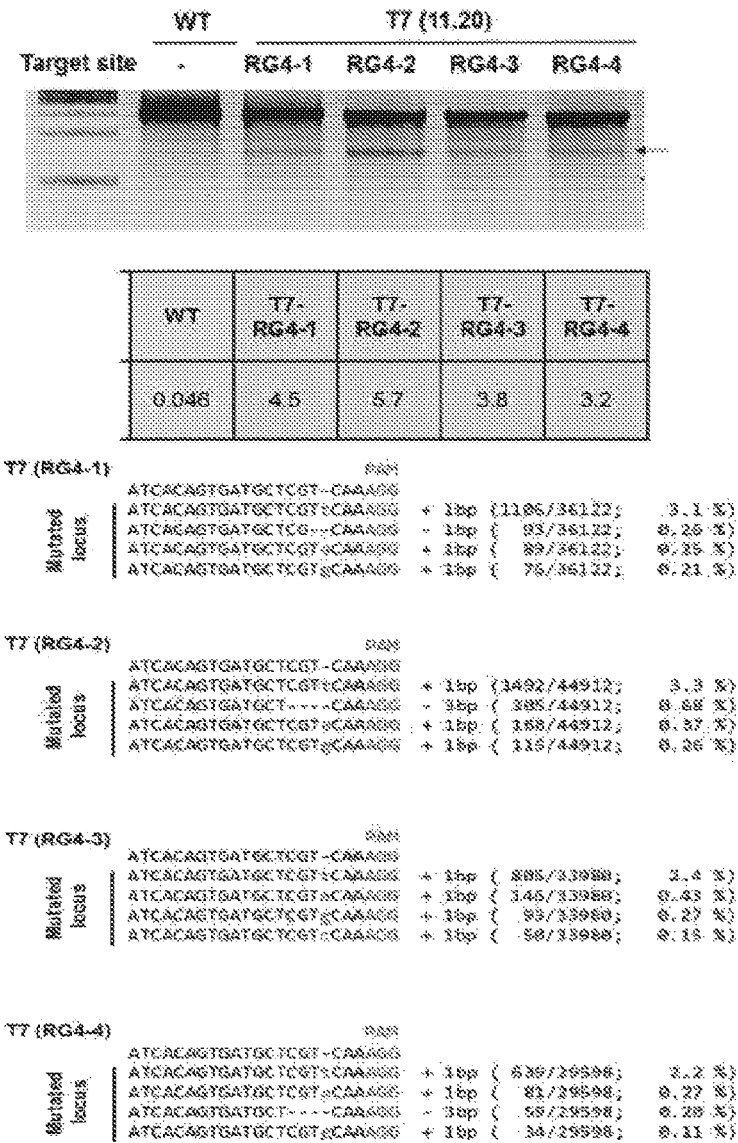

FIG. 46 illustrates regeneration of plantlets after gene editing (GE) in lettuce. Figure discloses SEQ ID NOS 188-192, 188-189, 193, 191-192, 188-189, 191-192, 194, 188-189, 191, 193 and 192, respectively, in order of appearance.

Figure 47:
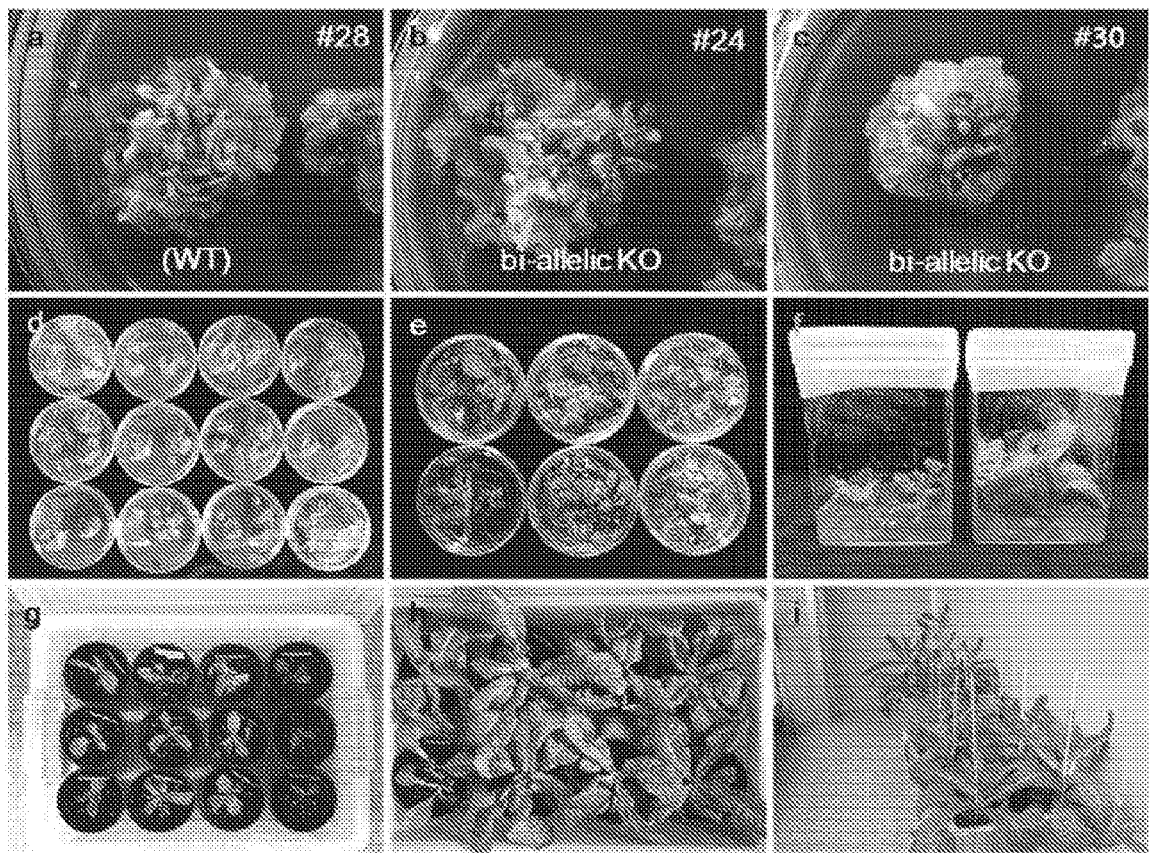

FIG. 47 illustrates regeneration of whole plants from edited protoplasts.

Figure 48:
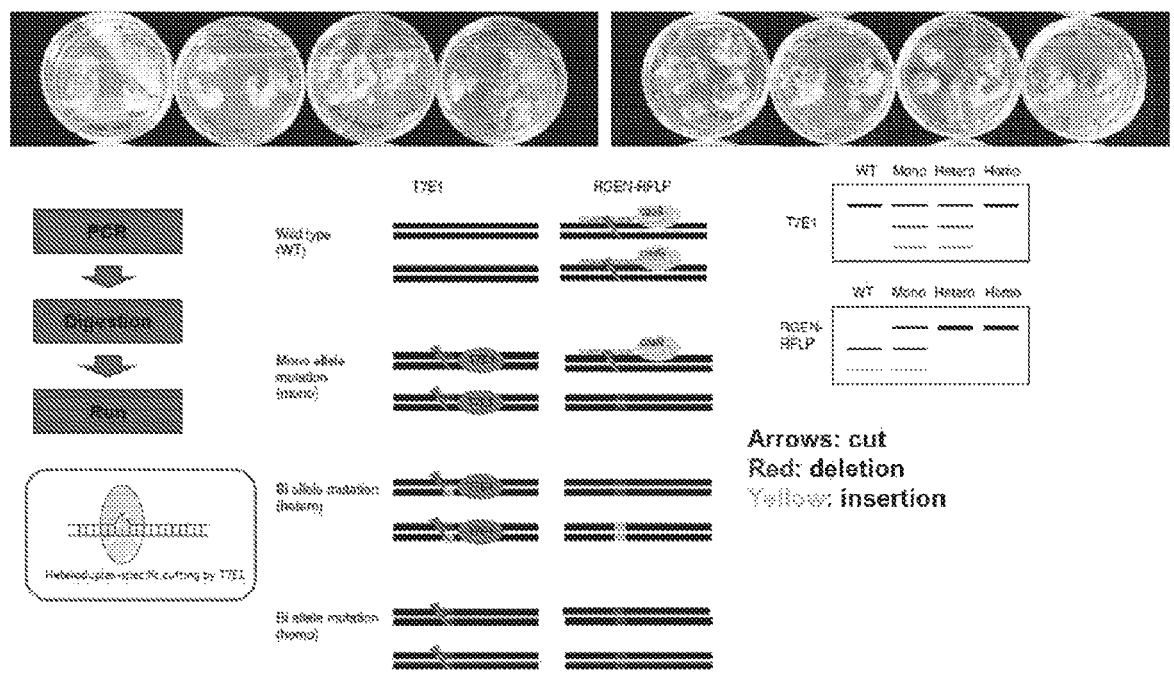

FIG. 48 illustrates identification of edited clones from non-edited clones by RNA guided endonuclease (RGEN).

Figure 49:
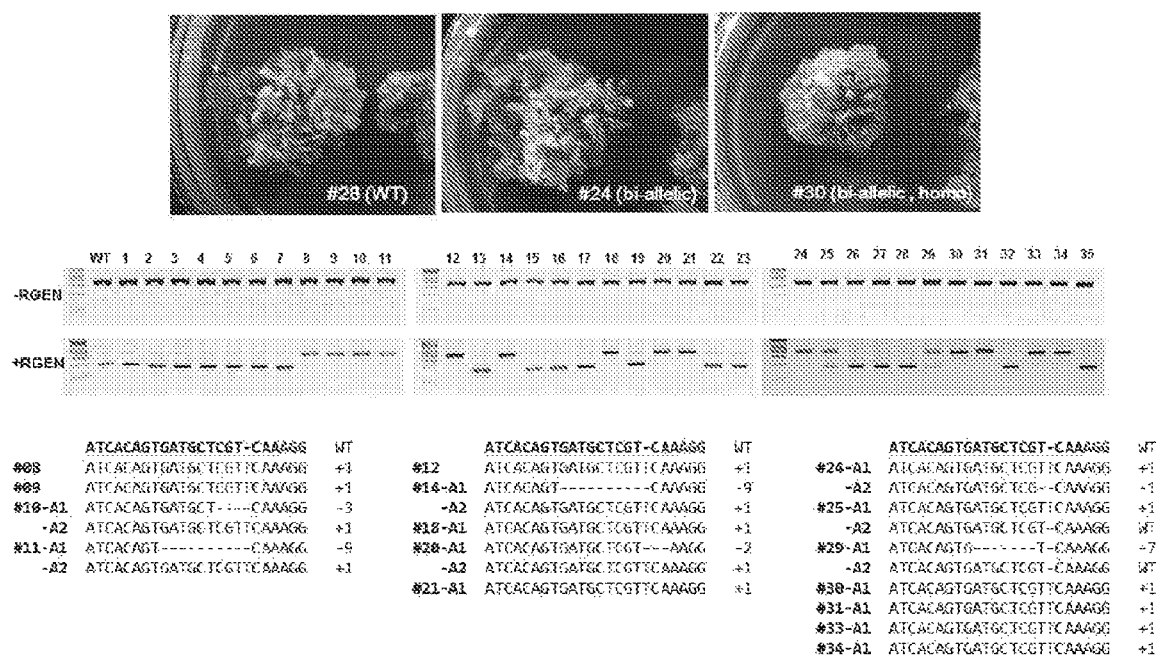

FIG. 49 illustrates nature of editing in regenerating plantlets. Figure discloses SEQ ID NOS 188-189, 189, 193, 189, 195, 189, 188-189, 195, 189, 188-189, 196, 189, 189, 188-190, 189, 188, 197, 188-189, 189, 189 and 189, respectively, in order of columns.

FIG. 50 illustrates the overall phenotype is not altered in biallelic heterozygous line. Figure discloses SEQ ID NOS 188 and 188-190, respectively, in order of columns.

Figure 51:
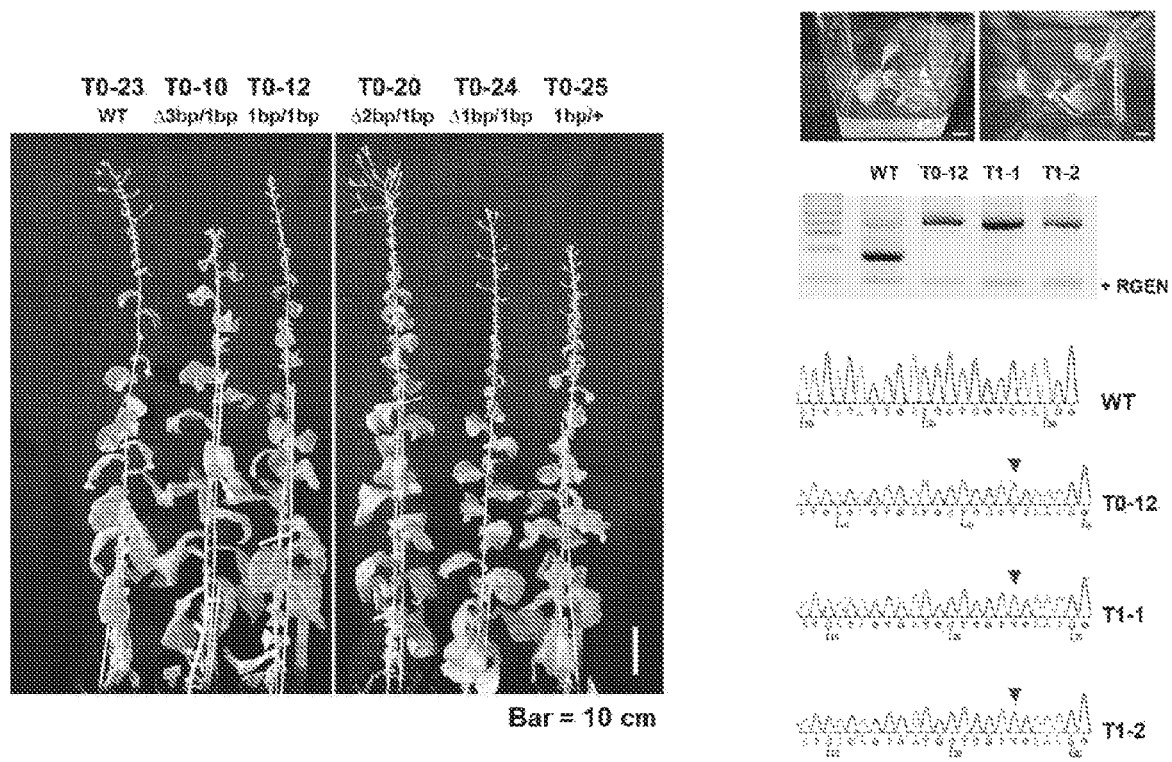

FIG. 51 illustrates germline transmission of the edited mutations. Figure discloses SEQ ID NOS 188-189, 189 and 189, respectively, in order of appearance.

FIG. 52 illustrates a number of potential off-target sites in the lettuce genome (Cas-OFFinder www.regenome.net).

FIG. 53 illustrates low indel frequencies at the on-target and 91 potential off-target sites. Figure discloses SEQ ID NOS 188 and 198-203, respectively, in order of appearance.

Figure 54:
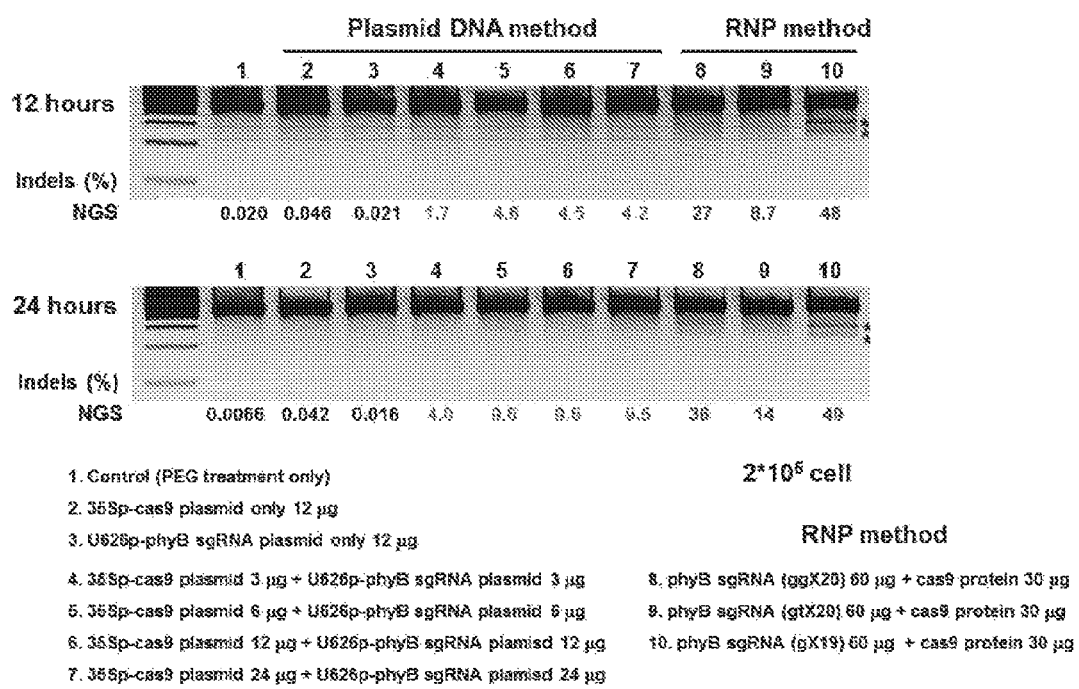

FIG. 54 illustrates a comparison of RNP vs DNA methods including time course efficiency.

FIG. 55 illustrates DNA vs RNP method including unwanted DNA integration issues. Figure discloses SEQ ID NOS 168, 204-205 and 205, respectively, in order of appearance.

Figure 56:
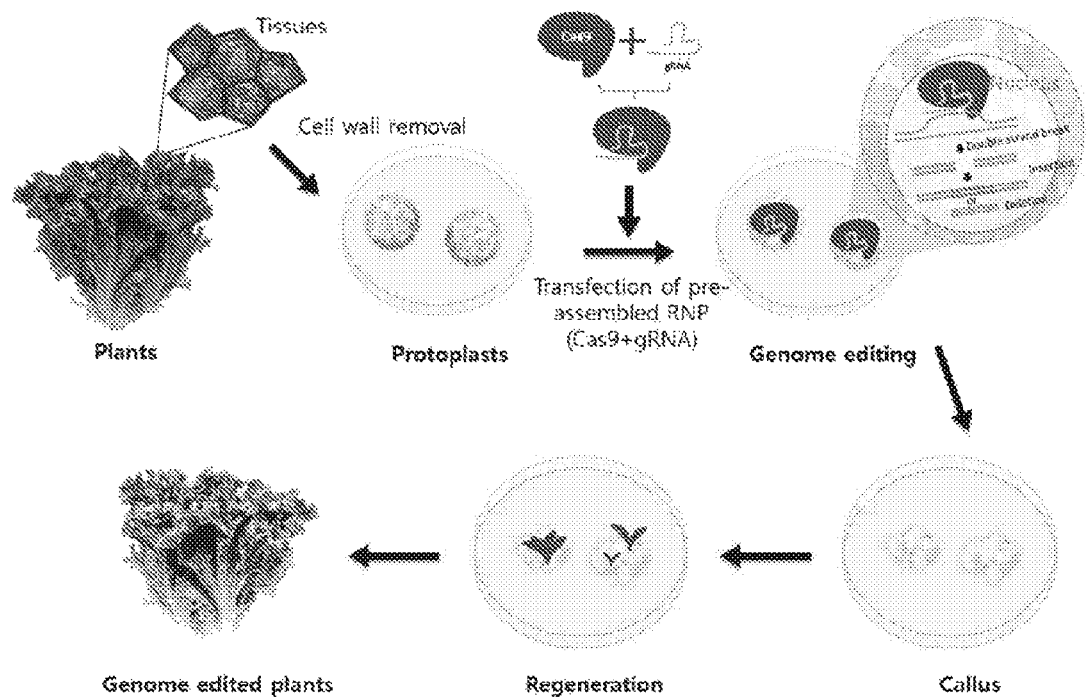

FIG. 56 illustrates a DNA-free genome editing procedure.

FIG. 57 illustrates the pros and cons of the RNP method in plants.

FIG. 58 illustrates at top, the substrate 1,431 bp, was used as templates (uncut). After cut, 707 bp (cut1) and 724 bp (cut2) were generated by SpCas9-sgRNA RNP complex, 120 nM SpyCas9 and 120 nM sgRNA. Substrate dsDNAs were used 11, 23, 34, 44, 57, 68, 79, 90 nM in this assay. RNP and templates were mixed and incubated for 1 h. Then, the mixture was subjected to DNA electrophoresis. The cleavage rate (%) of each DNA intensity was calculated by ImageJ program. The values of cut dsDNA was extracted from [substrate]×[cleavage rate/100]. At bottom, the figure shows a graph of the concentrations of Substrate dsDNA and Cut dsDNA as graphed by Michael-Menton kinetics. A small plot was graphed by lineweaver-burk.

FIG. 59 illustrates inactivation of SpyCas9 and FnCpf1 protein activities under stop solution treatment after 30 min. At top and to the left the figure shows that the PCR product-901 bp was used as templates (uncut). After cut, 552 bp (cut1) and 349 bp (cut2) were generated by SpyCas9-sgRNA RNP complex. 300 nM SpyCas9, 612 nM sgRNA, and 27 nM PCR products were used in this assay. At top and to the right, the figure shows the PCR product-1,431 bp was used as templates (uncut). After cut, 725 bp (cut1) and 706 bp (cut2) were generated by FnCpf1-crRNA RNP complex. 500 nM FnCpf1, 700 nM crRNA, and 30 nM PCR products were used in this assay. RNP and templates were mixed and incubated for 180 min. The mixture was aliquoted after 0, 10, 30, 60, and 180 min. Then, the aliquots were subjected to DNA electrophoresis. The percentage (%) of each DNA intensity was calculated by ImageJ program. After stop solution treatment at 30 min, all uncut dsDNAs were turned to cut1 and cut2 under no stop solution, while the 53% of uncut dsDNAs were not digested any more under stop solution along with time-course after stop solution in SpyCas9. At bottom, the figure shows graphs showing significant decreases in cleavage rate over incubation time with the addition of stop solutions in SpyCas9 and FnCpf1. Zinc was supplied with 1 mM $ZnSO_4$ after 30 min incubation. After 1 mM $ZnSO_4$ treatment at 30 min, all uncut dsDNAs were turned to cut1 and cut2 under no $ZnSO_4$ treatment, while the 65% of uncut dsDNAs were not digested any more after 1 mM $ZnSO_4$ treatment.

FIG. 60 illustrates that SpyCas9 protein activity depending on B buffer with pH gradients. pH ranges from 3 to 10 titrated by 0.5 N HCl or 1 N NaOH. The PCR product—901 bp was used as templates (uncut). After cut, 552 bp (cut1) and 349 bp (cut2) were generated by SpyCas9-sgRNA RNP complex. 300 nM SpyCas9, 612 nM sgRNA, and 27 nM PCR products were used in this assay. RNP and templates were mixed and incubated for 1 h and 3 h. Then, the mixture was subjected to DNA electrophoresis. The percentage (%) of each DNA intensity was calculated by ImageJ program. Higher pH showed higher RNP activity. Zinc was supplied with 1 mM $ZnSO_4$ in reaction buffer containing 10 mM $MgCl_2$ in E buffer.

FIG. 61 illustrates in vitro cleavage assay with circular dsDNA by SpyCas9 and SpyCas9-RecJ exonuclease. Circular dsDNA cleavage by SpyCas9 and SpyCas9-RecJ. Plasmid dsDNA C was used for circular dsDNA templates, and a sgRNA was used to guide Cas9 into target site before PAM. Linear dsDNA showed sharp and thick dsDNA size in DNA electrophoresis. After incubation SpyCas9/gRNA C apoproteins, SpyCas9 produced single sharp and thick dsDNA sizes without time-dependency, while SpyCas9-RecJ/gRNA showed blur, weak, thin, and tailed dsDNA, which stand for DNA degradation, after 60-180 minutes of incubation.

FIG. 62 illustrates CRISPR/Cas9-mediated genome editing. Ribonucleoprotein (RNP) complex comprising Cas9 apoprotein and guide RNA finds its target sequence complementary to the guide RNA. Endonuclease domains such as HNH and RuvC II cuts 3 bases upstream from PAM (5'-NGG-3') sequences to result in double strand break (DSB). DSB is repaired by a non-homologous end joining (NHEJ) process. NHEJ frequently causes error-prone ligation, but a majority of the DSB is repaired seamlessly without insertion or deletion mutations. Repair mechanisms result in three different outcomes: 1) error-free NHEJ, error-prone NHEJ, and homologous recombination in the presence of repair templates. Due to outperformance of error-free repair mechanisms relative to error-prone repair mechanisms, the apparent mutation rate is as low as 10% in vivo. We found a means for pushing the tendency toward error-prone process, thereby overcoming the low mutation rate. Figure discloses SEQ ID NOS 114-121, respectively, in order of appearance.

Figure 63:
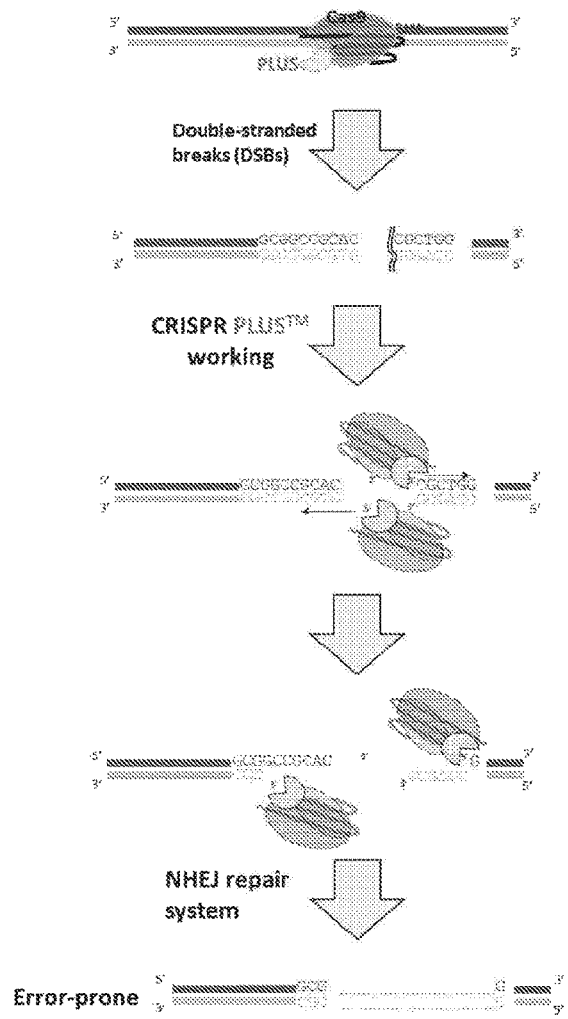

FIG. 63 illustrates a schematic showing that increasing the efficiency of error-prone NHEJ using novel Cas9-PLUS™ recombinant enzyme. Due to PLUS moiety fused to the C-terminus of Cas9 protein, the DNAs at DSB are irreversibly resected from 5' to 3' direction, which greatly decrease the possibility of error-free NHEJ process. Figure discloses SEQ ID NOS 114-115, 114-115 and 114, respectively, in order of appearance.

FIG. 64 illustrates gene editing efficiency in rice protoplasts. Each Cas9 variant and the same guide RNA against the same loci of rice Dwarf5 were transfected to protoplasts of 1-week-old rice. Rice protoplasts using PEG or lipid mediated transfection method. Cells were harvested at 48 hour after transfection for genomic DNA extraction. In order to improve discriminability of cut DNA band, alternative PCR primer pairs were used and that resulted in clearer single whose sizes, which were subjected to T7E1 assay and SpyCas9/sgRNA. SpyCas9/sgRNA. sgRNA sequence is TCAACCACCCTGTGAATTT (SEQ ID NO: 57). Primer pairs for PCR are F1, GGATTGGATTGGTATTGTCGT (SEQ ID NO: 58); R1, TCACTTTTGATGAACTAT (SEQ ID NO: 59)

FIG. 65 illustrates a comparison of indels in PCR product sequences after SpyCas9 and SpyCas9-PLUS' digest circular dsDNA. SpCas9 was treated for 1 h, The cleaved dsDNAs were subjected to mungbean exonuclease treatment, and then the cleaved dsDNAs were subjected to gel electrophoresis for 40 min. The single linear DNA sizes were eluted, cleaned-up, and ligated their own linear dsDNA, and then read the cleavage site of 32 colonies by SpyCas9. One 6-nt deletion was detected (left panel). SpyCas9-PLUS™ was treated for 1 h, The cleaved dsDNAs were subjected to mungbean exonuclease treatment, and then the cleaved dsDNAs were subjected to gel electrophoresis for 40 min. The single linear DNA sizes were eluted, cleaned-up, and ligated their own linear dsDNA, and then read the cleavage site of 32 colonies by SpyCas9-PLUS™. One 3-nt, one 6-nt, and two 15-nt deletion sequences were detected (right panel).

FIG. 66 illustrates a time course of gene editing efficiency in HEK293 cells. (a-b) Each Cas9 variant and the same guide RNA against the same loci of human DHCR7 complex were transfected to HEK293 cells using a lipid mediated transfection method. Cells were harvested at different time points, from 0 hours, as a control, to 72 hours, for genomic DNA extraction. In order to improve discriminability of a cut DNA band, an alternative PCR primer pair was used and that resulted in clearer single band whose size is nearly 300 bp, which was a product of T7E1 endonuclease activity and therefore measured to compare % indel. Figures discloses SEQ ID NO: 78.

Figure 67:
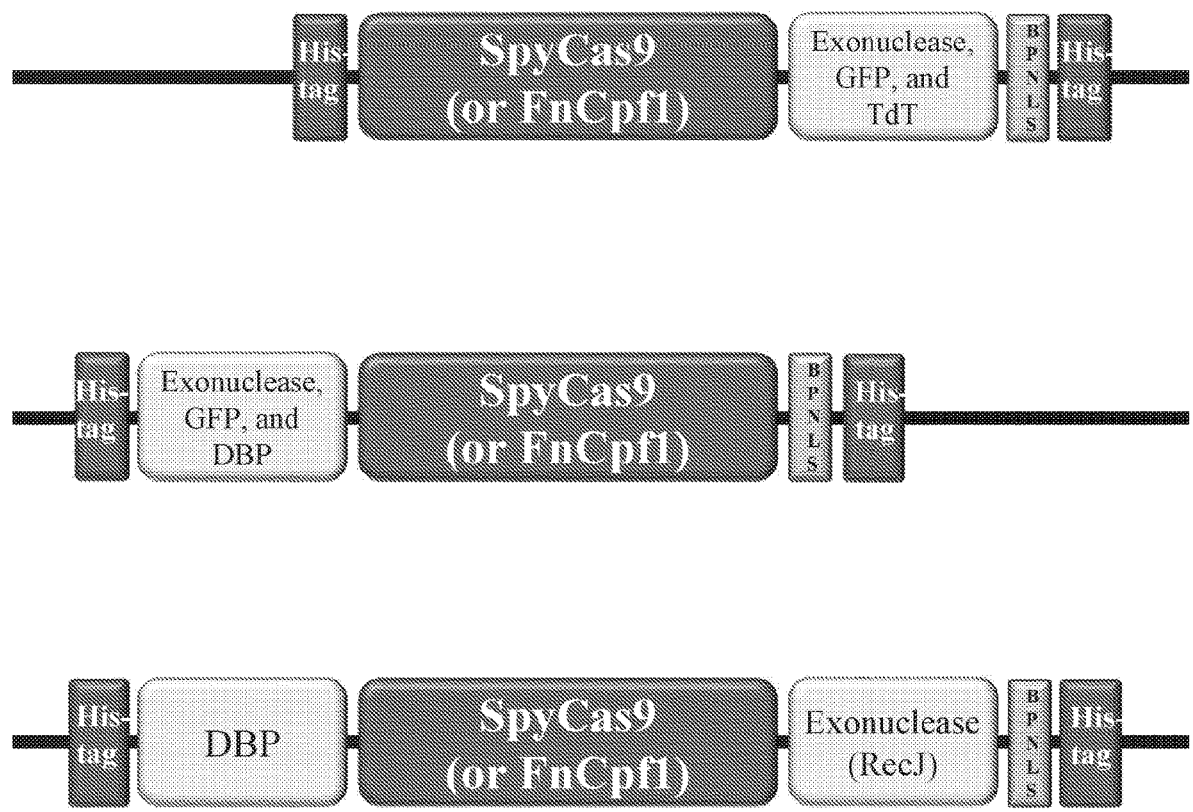

FIG. 67 illustrates schematic gene structures of CRISPR PLUS. Shown at top is a schematic of C-terminal fusion proteins to SpyCas9 or FnCpf1. Shown in the middle is a schematic of N-terminal fusion proteins to SpyCas9 or FnCpf1. Shown at the bottom is a schematic of both N and C terminal fusion proteins to SpyCas9 or FnCpf1.

Figure 68:
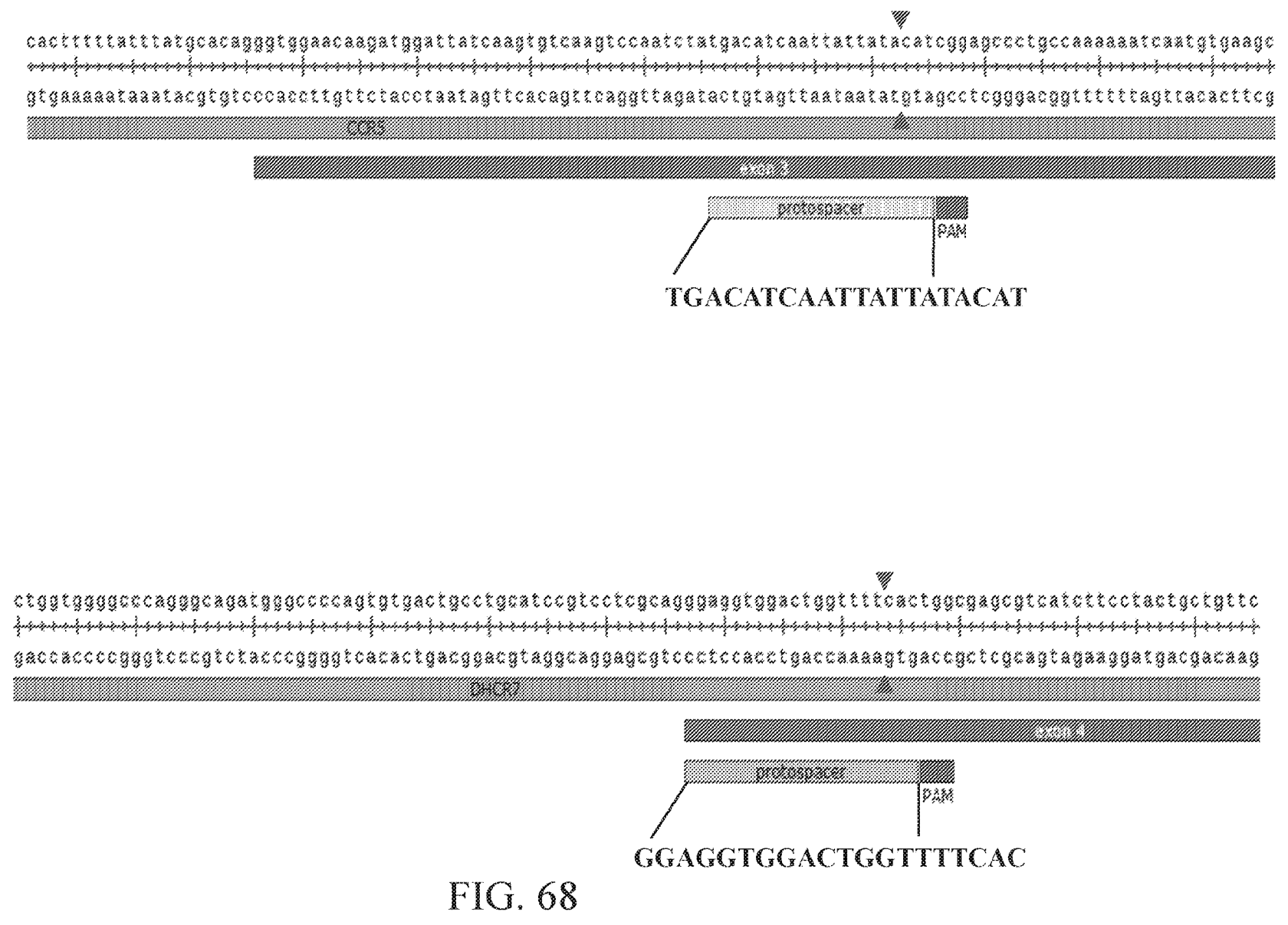

FIG. 68 illustrates sgRNA binding sites of SpyCas9 for CCR5 and DHCR7. Each sgRNA binding region of SpyCas9 for human CCR5 (shown at top) and DHCR7 (shown at bottom) is shown in the boxes containing the text "protospacer." The PAM sequence immediately follows the box labeled "protospacer." Arrows indicate nuclease cutting site. Figure discloses SEQ ID NOS 206, 91, 207 and 92, respectively, in order of appearance.

FIG. 69 illustrates crRNA binding sites of FnCpf1 for CCR5 and DNMT1. Each crRNA binding region of FnCpf1 for human CCR5 (shown at top) and DMNT1 (shown below) is shown in the boxes containing the text "protospacer." The PAM sequence immediately precedes the boxes containing the text "protospacer." Arrows indicate nuclease cutting site. Figure discloses SEQ ID NOS 208-211, respectively, in order of appearance.

Figure 70:
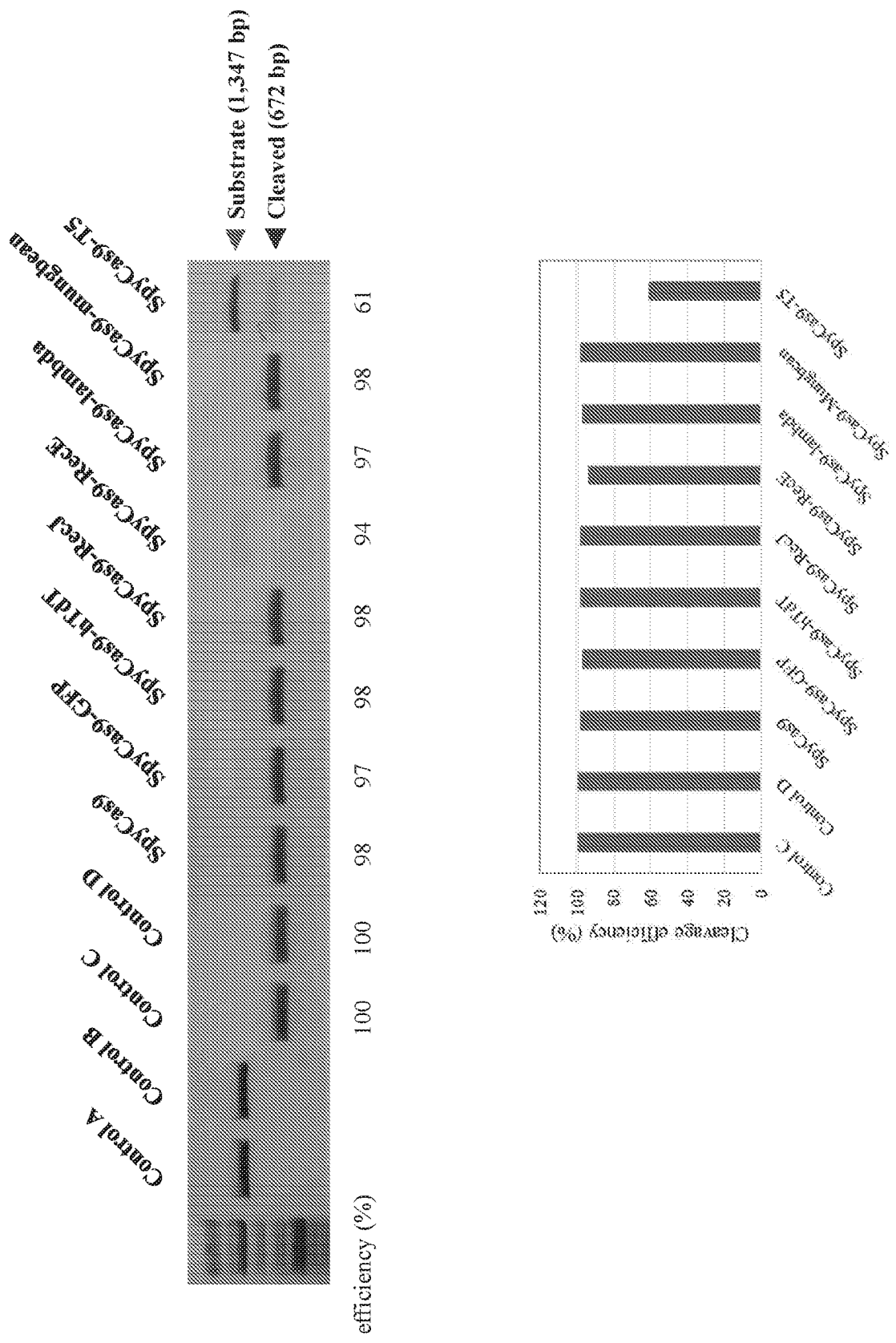

FIG. 70 illustrates in vitro cleavage assay of SpyCas9 and fusion proteins at C-terminus of SpyCas9 against human CCR5. The concentration of each RNP is 25 nM. 'Control A' means no treatment of both gRNA and protein. 'Control B' contains only sgRNA. 'Control C' is the mixture of sgRNA and protein. 'Control D' is the mixture of newly synthesized sgRNA and protein. Fusion proteins at C-terminus of SpyCas9 don't disturb SpyCas9 activity except for T5. Shown at the top is a gel and shown below is a bar graph showing percent cleavage efficiency for each group.

Figure 71:
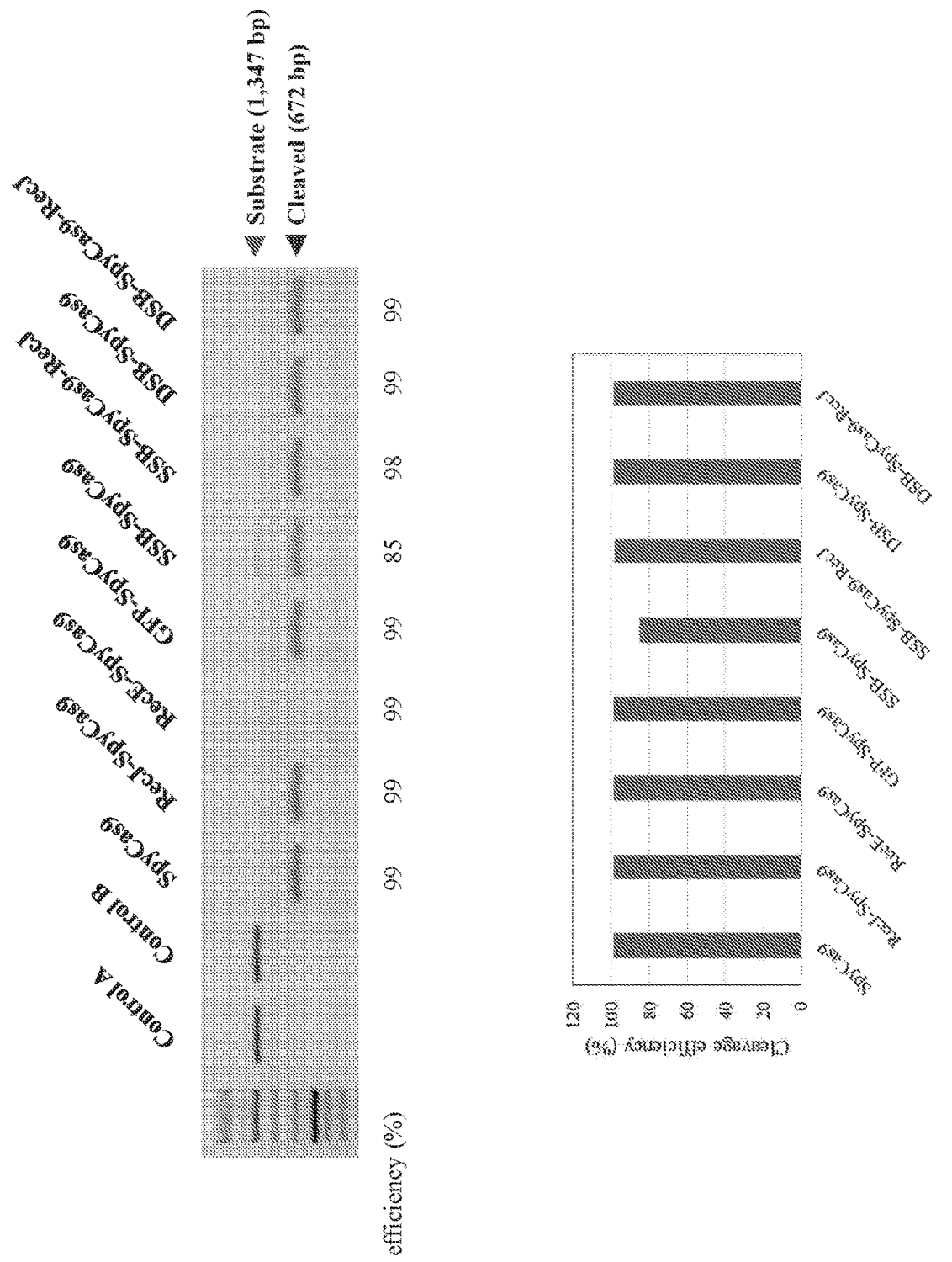

FIG. 71 illustrates in vitro cleavage assay of SpyCas9 and fusion proteins at N- or N, C both termini of SpyCas9 against human CCR5. The concentration of each RNP is 25 nM. 'Control A' means no treatment of both gRNA and protein. 'Control B' contains only sgRNA. Fusion proteins at N- or both N, C termini of SpyCas9 do not disturb SpyCas9 activity except for SSB-SpyCas9. Shown at top is a gel and shown below is a bar graph showing percent cleavage efficiency for each group.

Figure 72:
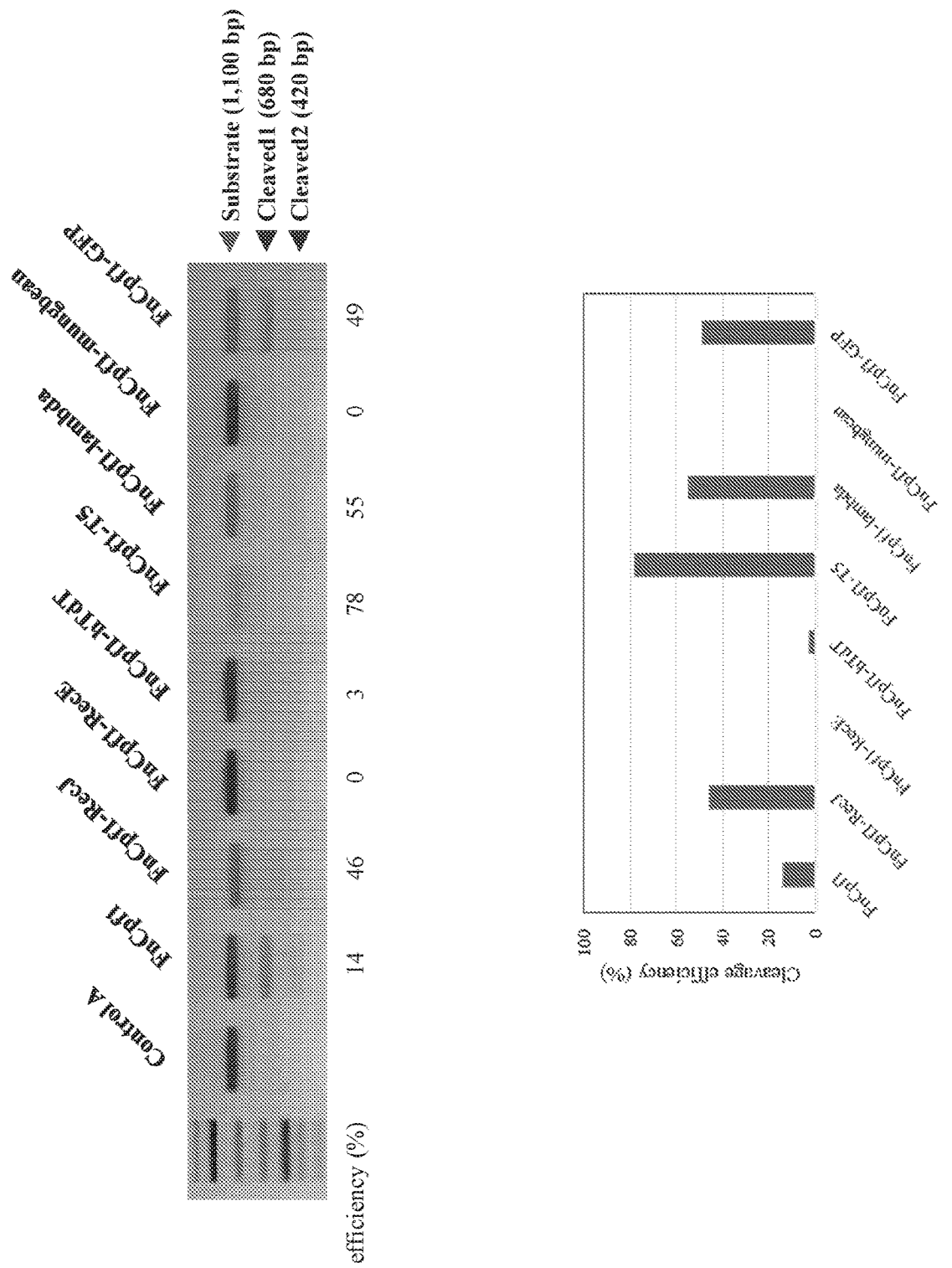

FIG. 72 illustrates in vitro cleavage assay of FnCpf1 and fusion proteins at C-terminus of FnCpf1 against human CCR5. The concentration of each RNP is 50 nM. 'Control A' contains only FnCpf1 protein. Fusion proteins at C-terminus of FnCpf1 do not disturb FnCpf1 activity except RecE, hTdT, and mungbean. Shown at the top is a gel and shown below is a bar graph showing percent cleavage efficiency for each group.

Figure 73:
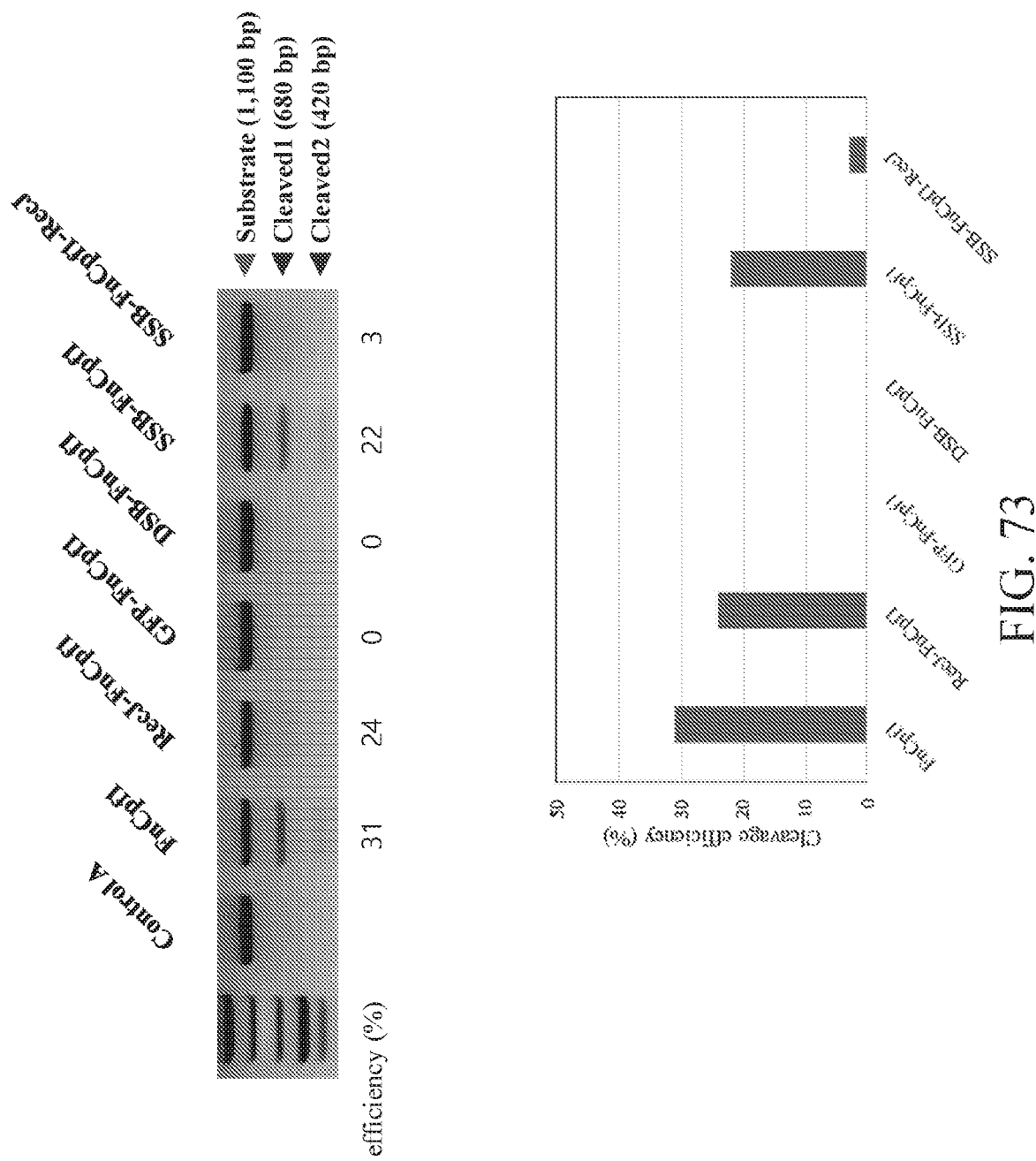

FIG. 73 illustrates in vitro cleavage assay of FnCpf1 and fusion proteins at N- or N, C both termini of FnCpf1 against human CCR5. The concentration of each RNP is 50 nM. 'Control A' contains only FnCpf1 protein. Fusion proteins of FnCpf1 do not disturb FnCpf1 activity significantly except GFP, DSB, and SSB-FnCpf1-RecJ. Shown at the top is a gel and shown below is a bar graph showing percent cleavage efficiency for each group.

FIG. 74 illustrates editing efficiency comparison between SpyCas9 and C-terminal fusion proteins to SpyCas9. SpyCas9 and SpyCas9 fusion proteins at C-terminus (GFP, hTdT, and well known exonucleases such as RecJ, RecE, lambda, mungbean, and T5) show different genome editing efficiency. Shown at the left is a bar graph of knock-out efficiency as measured by percent indels for each group and shown at the right is a bar graph of percent homology directed repair (HDR) for each group.

Figure 75:
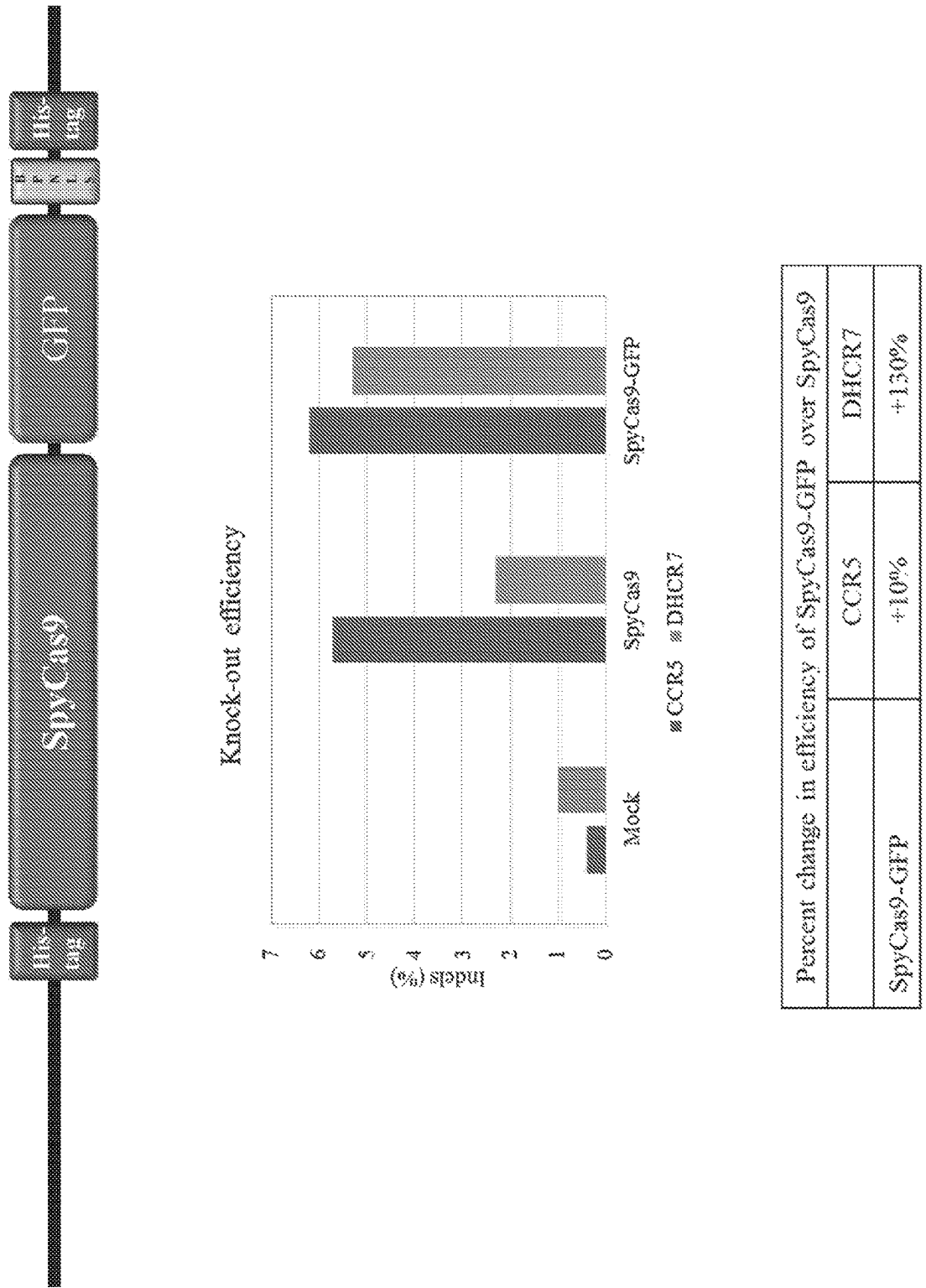

FIG. 75 illustrates a comparison of knock-out efficiencies between SpyCas9 and SpyCas9-GFP. Shown at top is a schematic of SpyCas9-GFP construct. Shown in the middle is a graph of editing efficiency for mock, SpyCas9, and SpyCas9-GFP treatment. Shown at the bottom is a table providing the percent change in efficiency of SpyCas9-GFP over SpyCas9. SpyCas9-GFP could be not only visualized and traced as a fluorescent probe but also enhanced knock-out efficiency.

Figure 76:
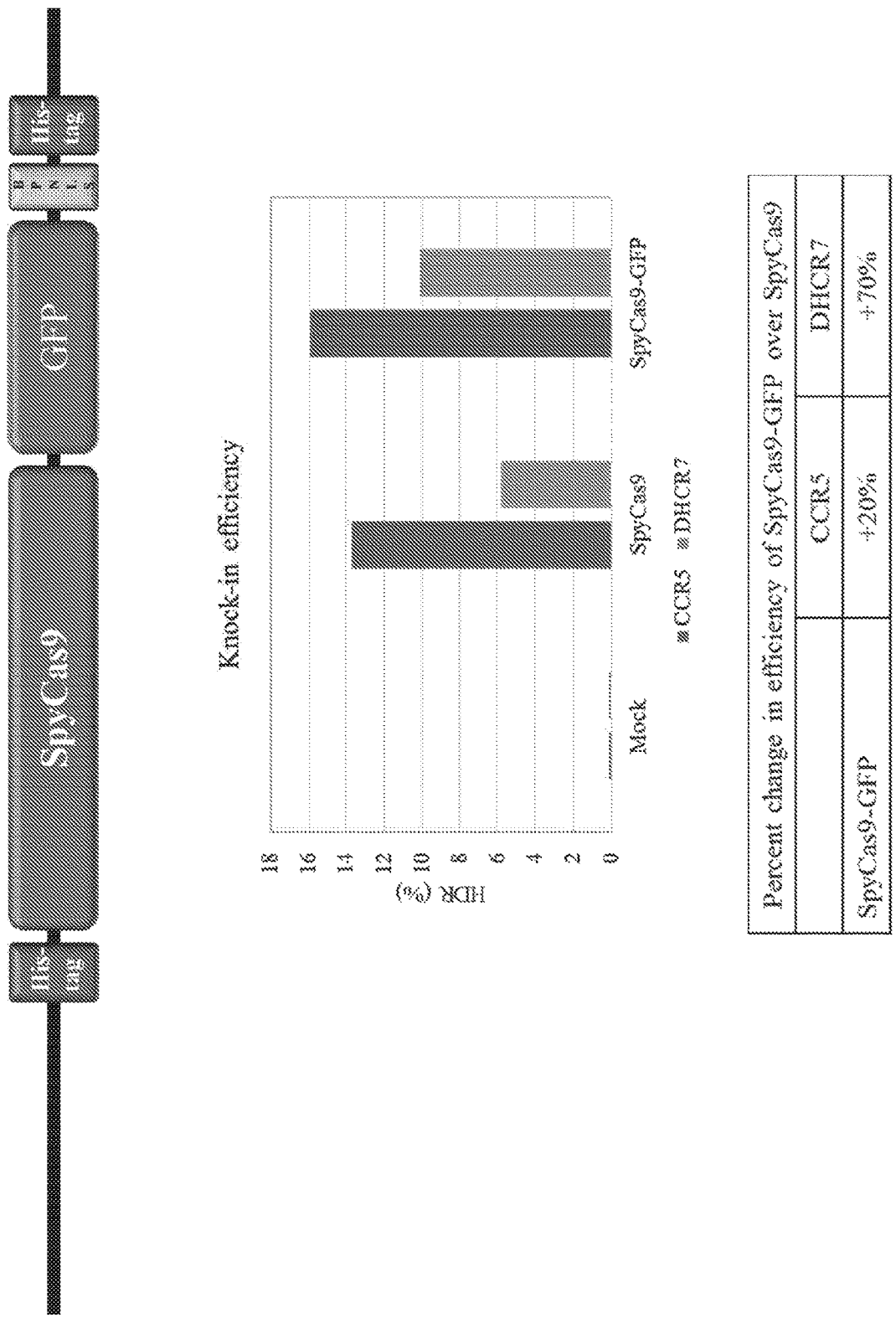

FIG. 76 illustrates a comparison of knock-in efficiencies between SpyCas9 and SpyCas9-GFP. Shown at top is a schematic of SpyCas9-GFP construct. Shown in the middle is a graph of editing efficiency at mock, SpyCas9, and SpyCas9-GFP treatment. Shown at the bottom is a table providing the percent change in efficiency of SpyCas9-GFP over SpyCas9. SpyCas9-GFP could be not only visualized and traced as a fluorescent probe but also enhance knock-in efficiency.

Figure 77:
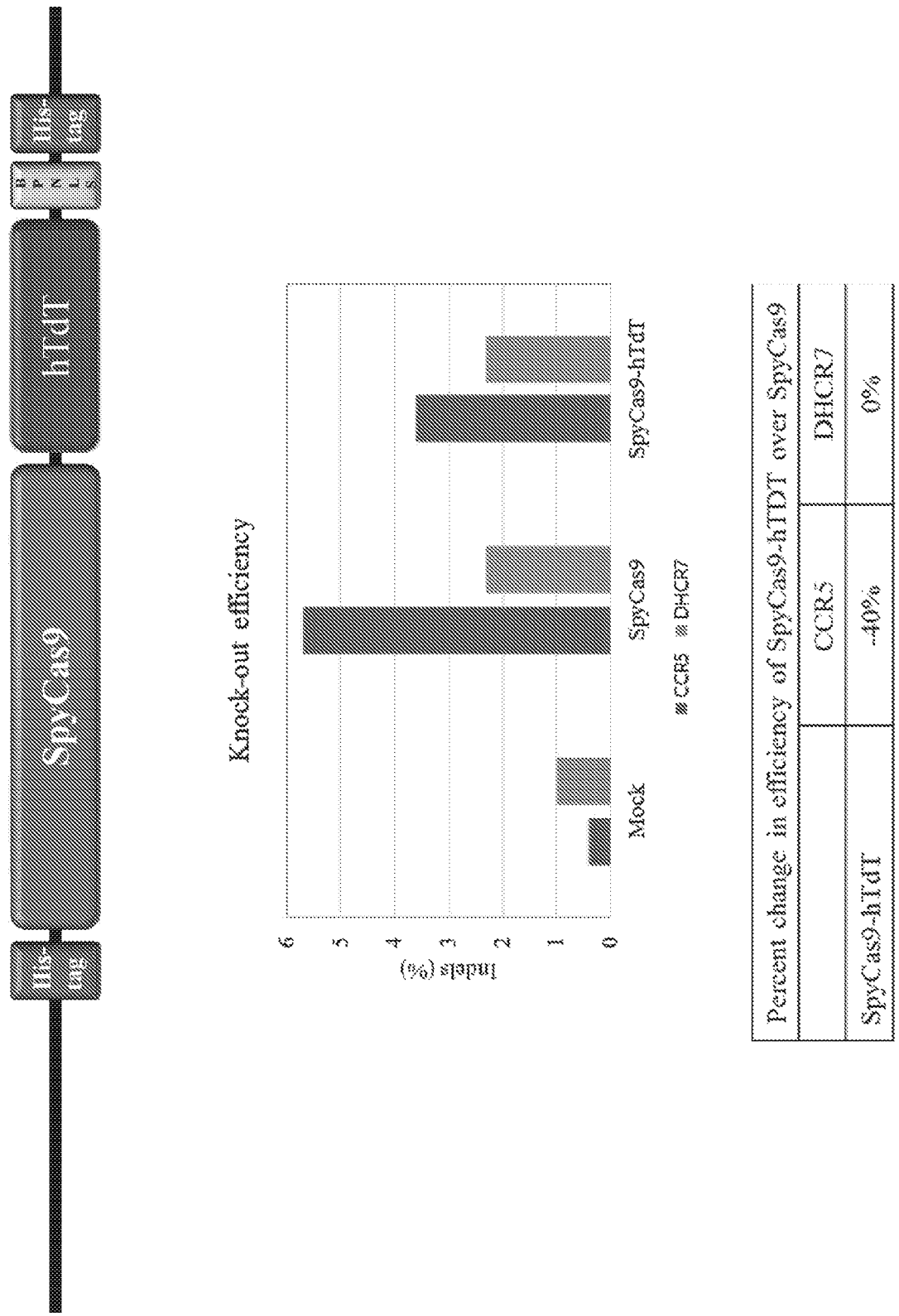

FIG. 77 illustrates a comparison of knock-out efficiencies between SpyCas9 and SpyCas9-hTdT. Shown at top is a schematic of SpyCas9-hTdT construct. Shown in the middle is a graph of editing efficiency for mock, SpyCas9, and SpyCas9-hTdT treatment. Shown at the bottom is a table providing the percent change in efficiency of SpyCas9-hTdT over SpyCas9.

Figure 78:
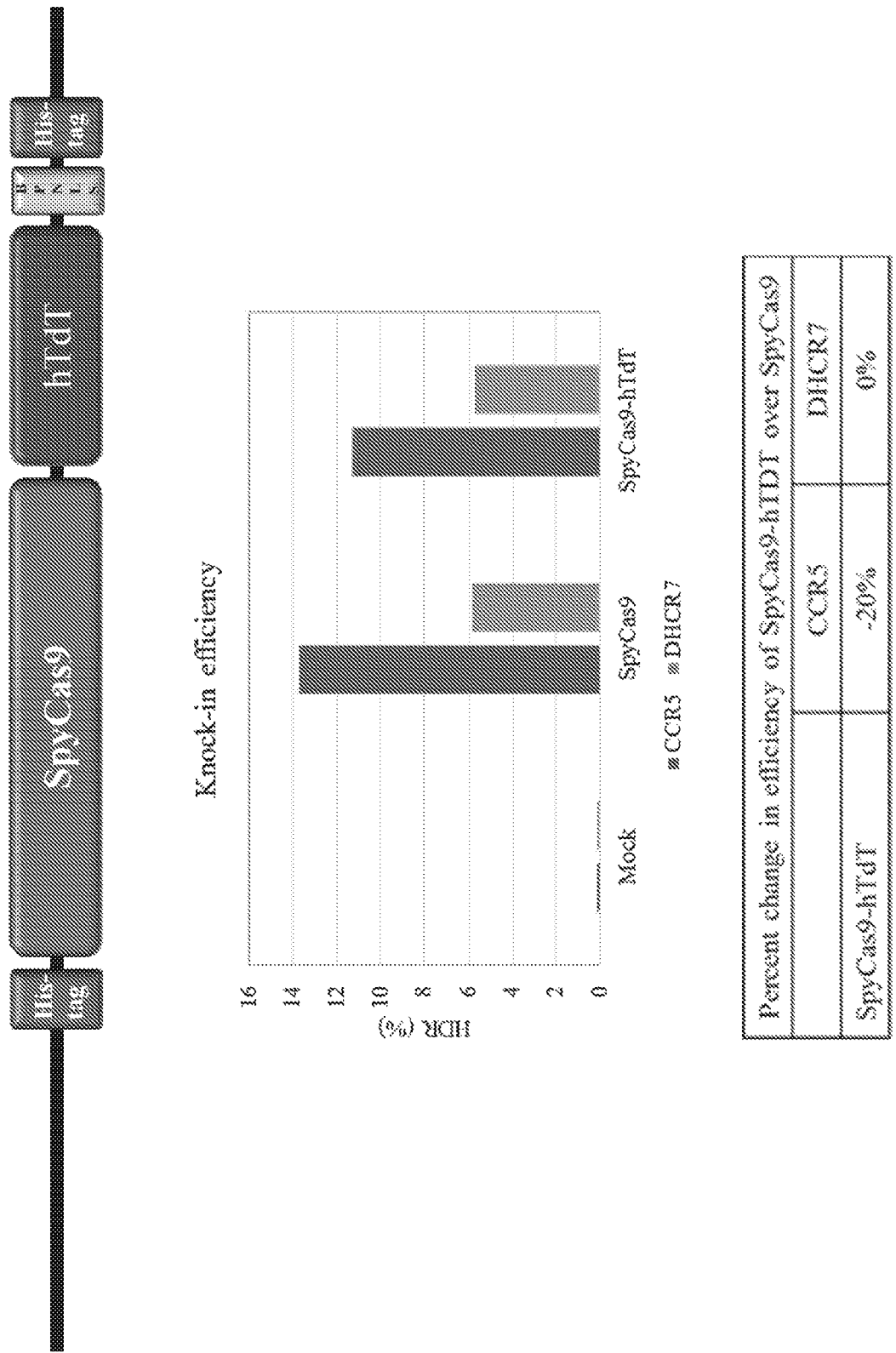

FIG. 78 illustrates a comparison of knock-in efficiencies between SpyCas9 and SpyCas9-hTdT. Shown at top is a schematic of SpyCas9-hTdT construct. Shown in the middle is a graph of editing efficiency at mock, SpyCas9, and SpyCas9-hTdT treatment. Shown at the bottom is a table providing the percent change in efficiency of SpyCas9-hTdT over SpyCas9.

Figure 79:
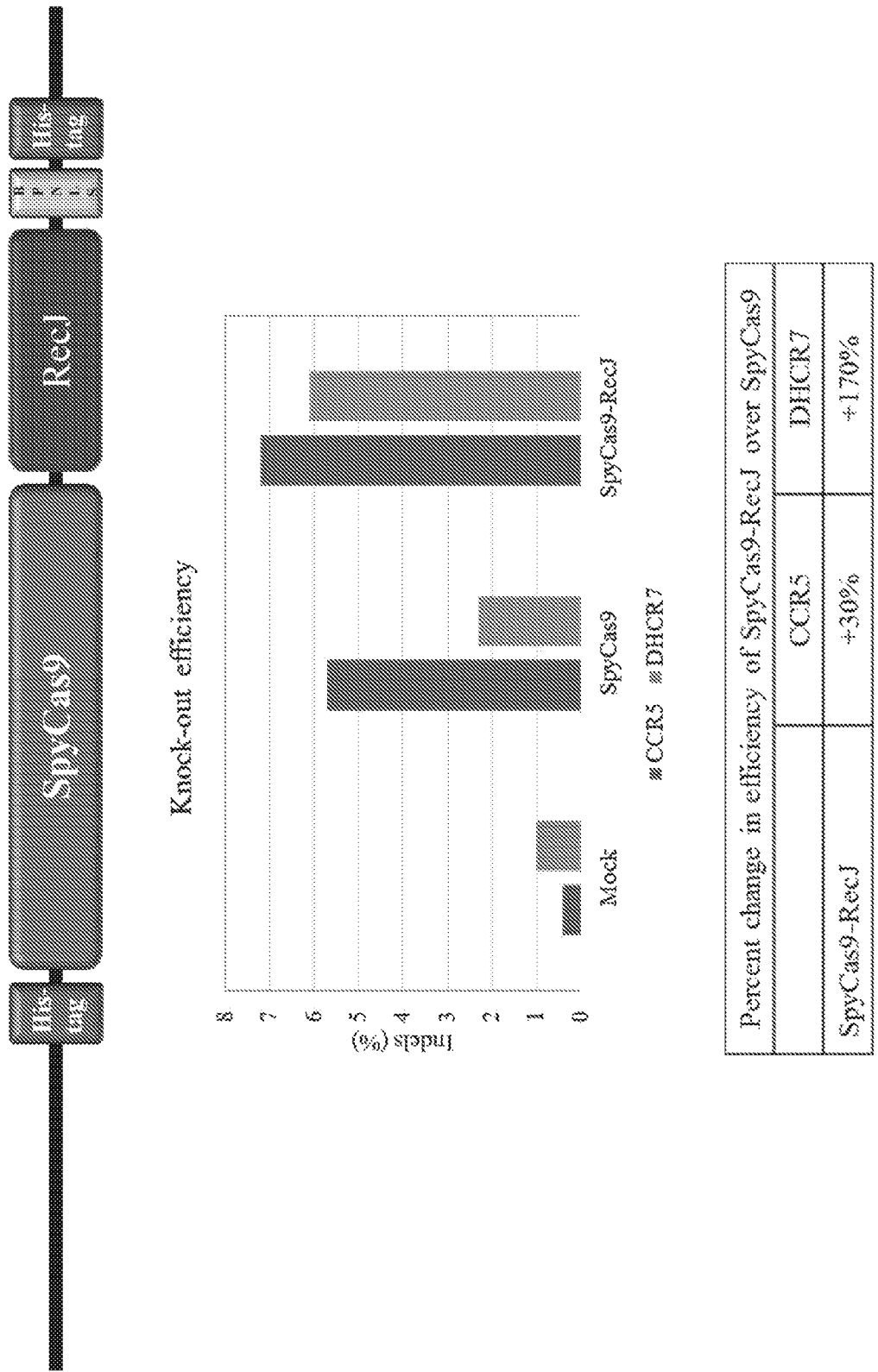

FIG. 79 illustrates a comparison of knock-out efficiencies between SpyCas9 and SpyCas9-RecJ. Shown at top is a schematic of SpyCas9-RecJ construct. Shown in the middle is a graph of editing efficiency at mock, SpyCas9, and SpyCas9-RecJ treatment. Shown at the bottom is a table providing the percent change in efficiency of SpyCas9-RecJ over SpyCas9.

Figure 80:
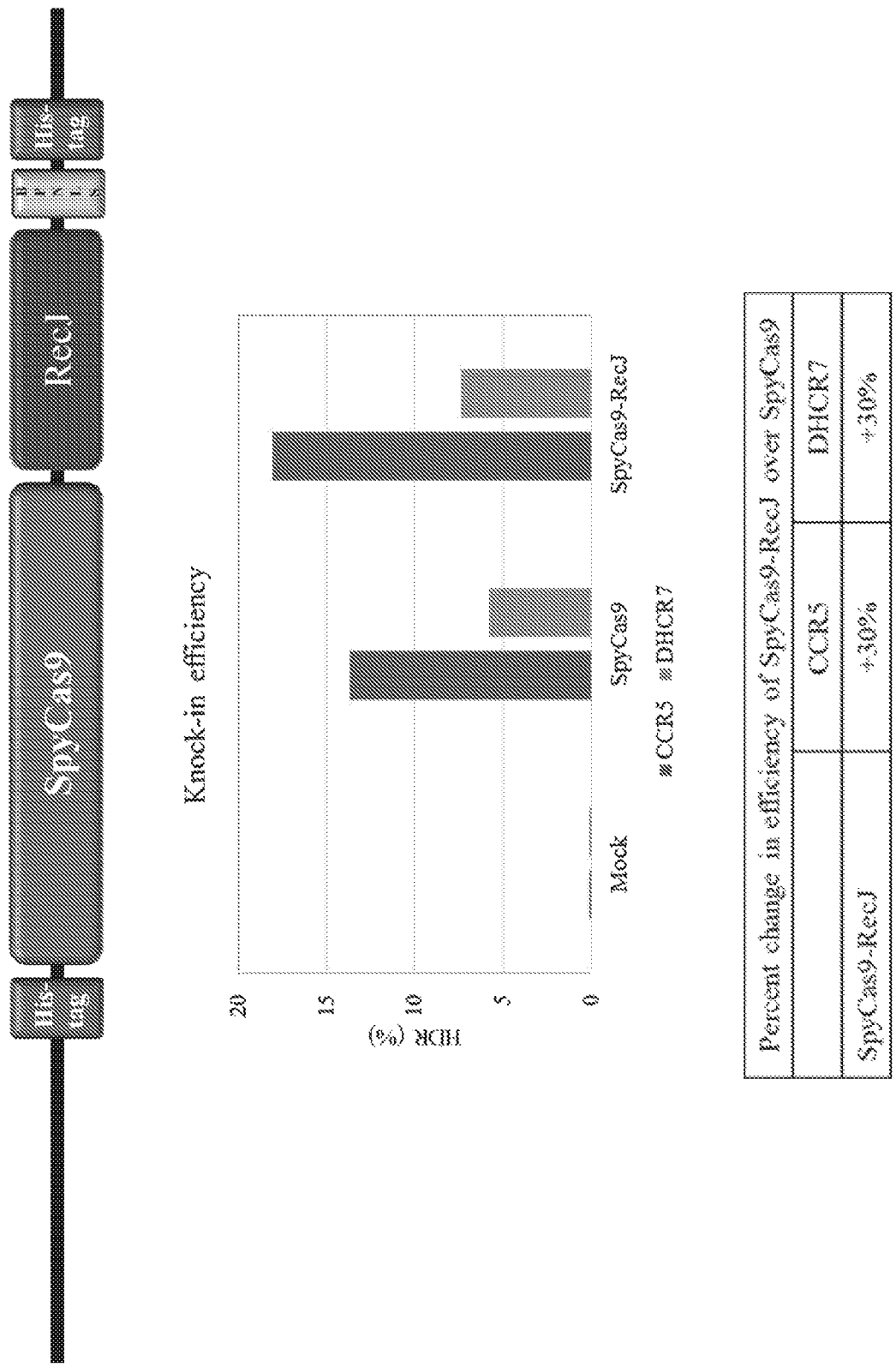

FIG. 80 illustrates a comparison of knock-in efficiencies between SpyCas9 and SpyCas9-RecJ. Shown at top is a schematic of SpyCas9-RecJ construct. Shown in the middle is a graph of editing efficiency at mock, SpyCas9, and SpyCas9-RecJ treatment. Shown at the bottom is a table providing the percent change in efficiency of SpyCas9-RecJ over SpyCas9.

Figure 81:
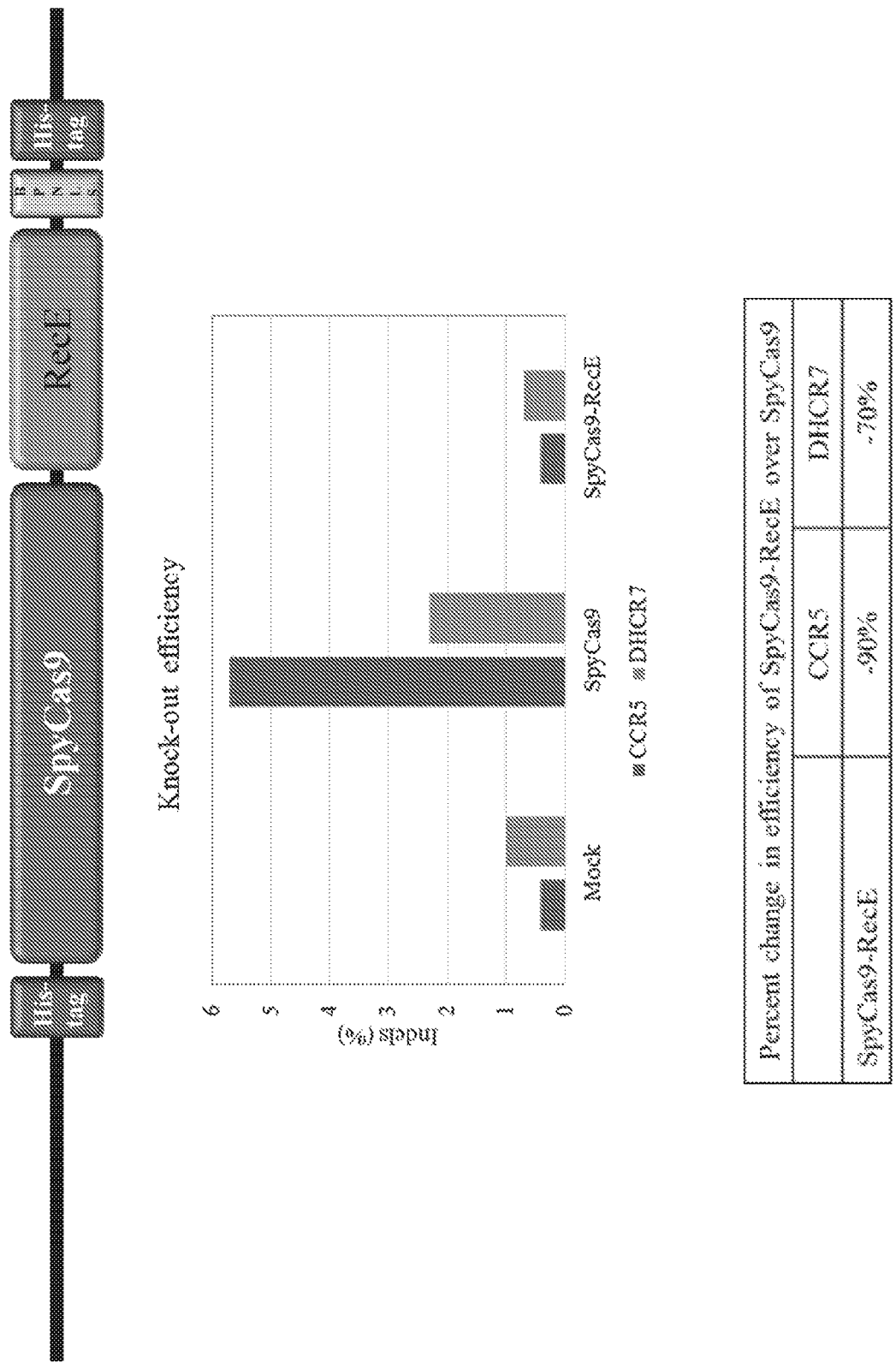

FIG. 81 illustrates a comparison of knock-out efficiencies between SpyCas9 and SpyCas9-RecE. Shown at top is a schematic of SpyCas9-RecE construct. Shown in the middle is a graph of editing efficiency at mock, SpyCas9, and SpyCas9-RecE treatment. Shown at the bottom is a table providing the percent change in efficiency of SpyCas9-RecE over SpyCas9.

Figure 82:
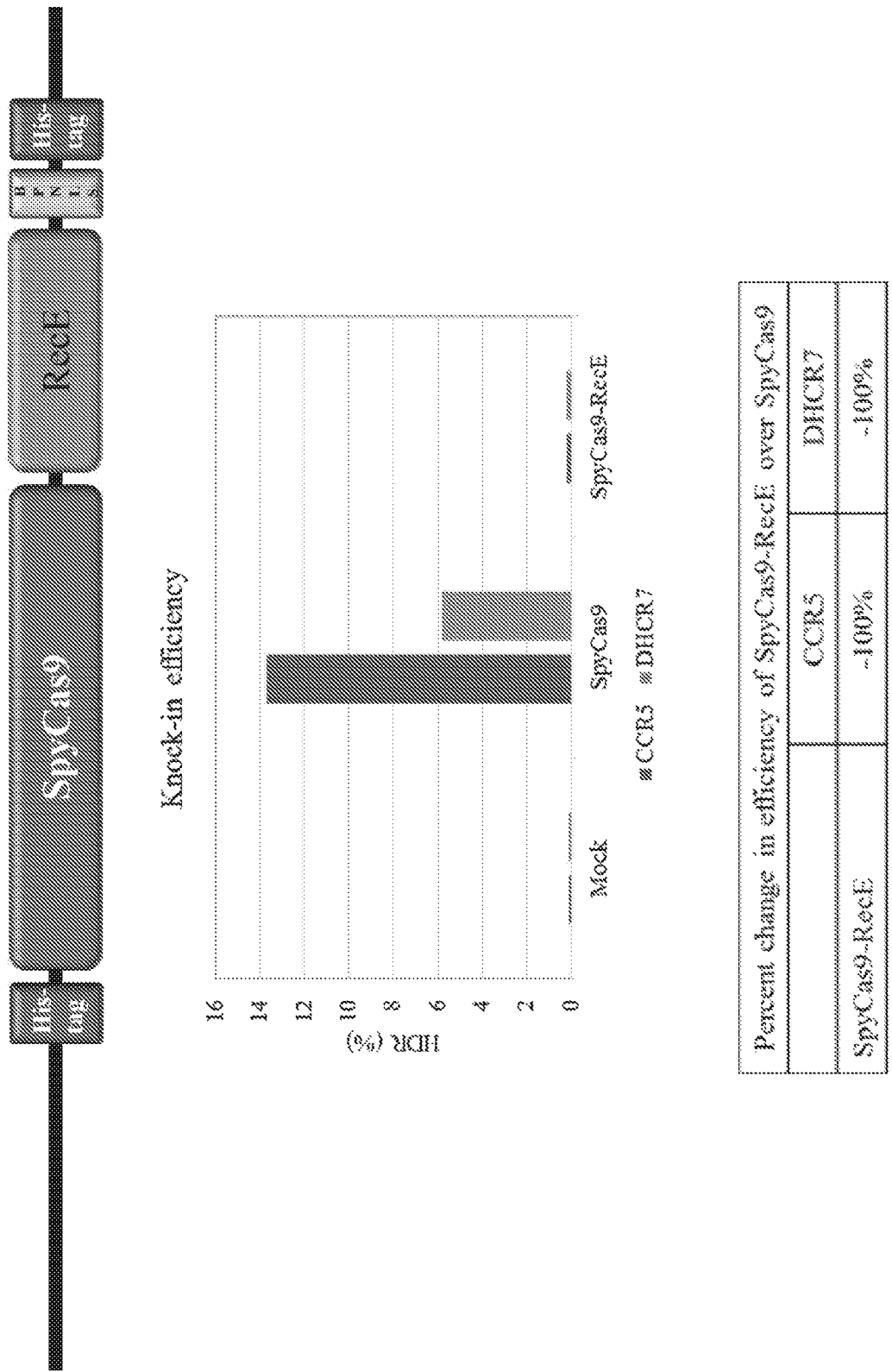

FIG. 82 illustrates a comparison of knock-in efficiencies between SpyCas9 and SpyCas9-RecE. Shown at top is a schematic of SpyCas9-RecE construct. Shown in the middle is a graph of editing efficiency at mock, SpyCas9, and SpyCas9-RecE treatment. Shown at the bottom is a table providing the percent change in efficiency of SpyCas9-RecE over SpyCas9.

Figure 83:
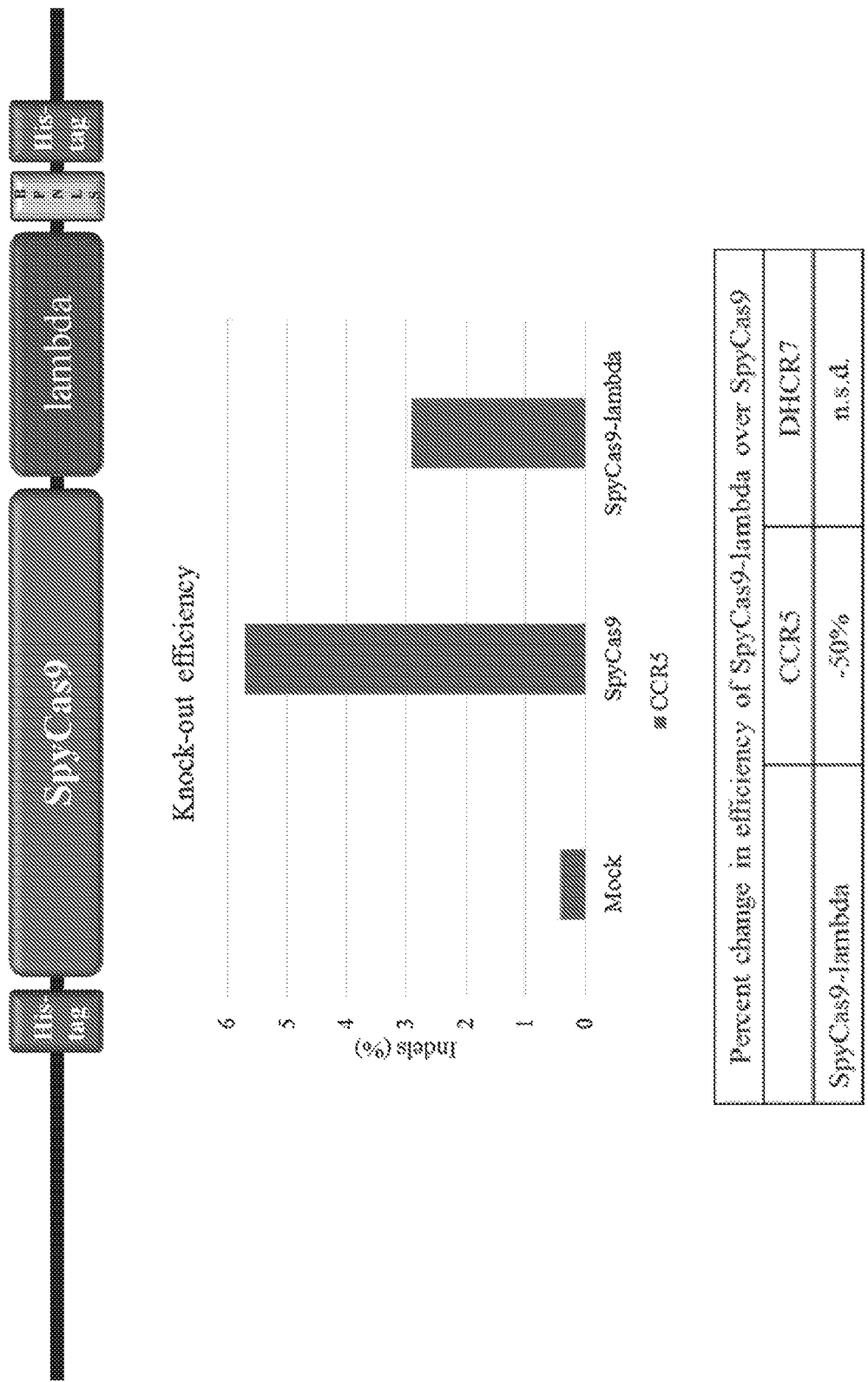

FIG. 83 illustrates a comparison of knock-out efficiencies between SpyCas9 and SpyCas9-lambda. Shown at top is a schematic of SpyCas9-lambda construct. Shown in the middle is a graph of editing efficiency at mock, SpyCas9, and SpyCas9-lambda treatment. Shown at the bottom is a table providing the percent change in efficiency of SpyCas9-lambda over SpyCas9.

Figure 84:
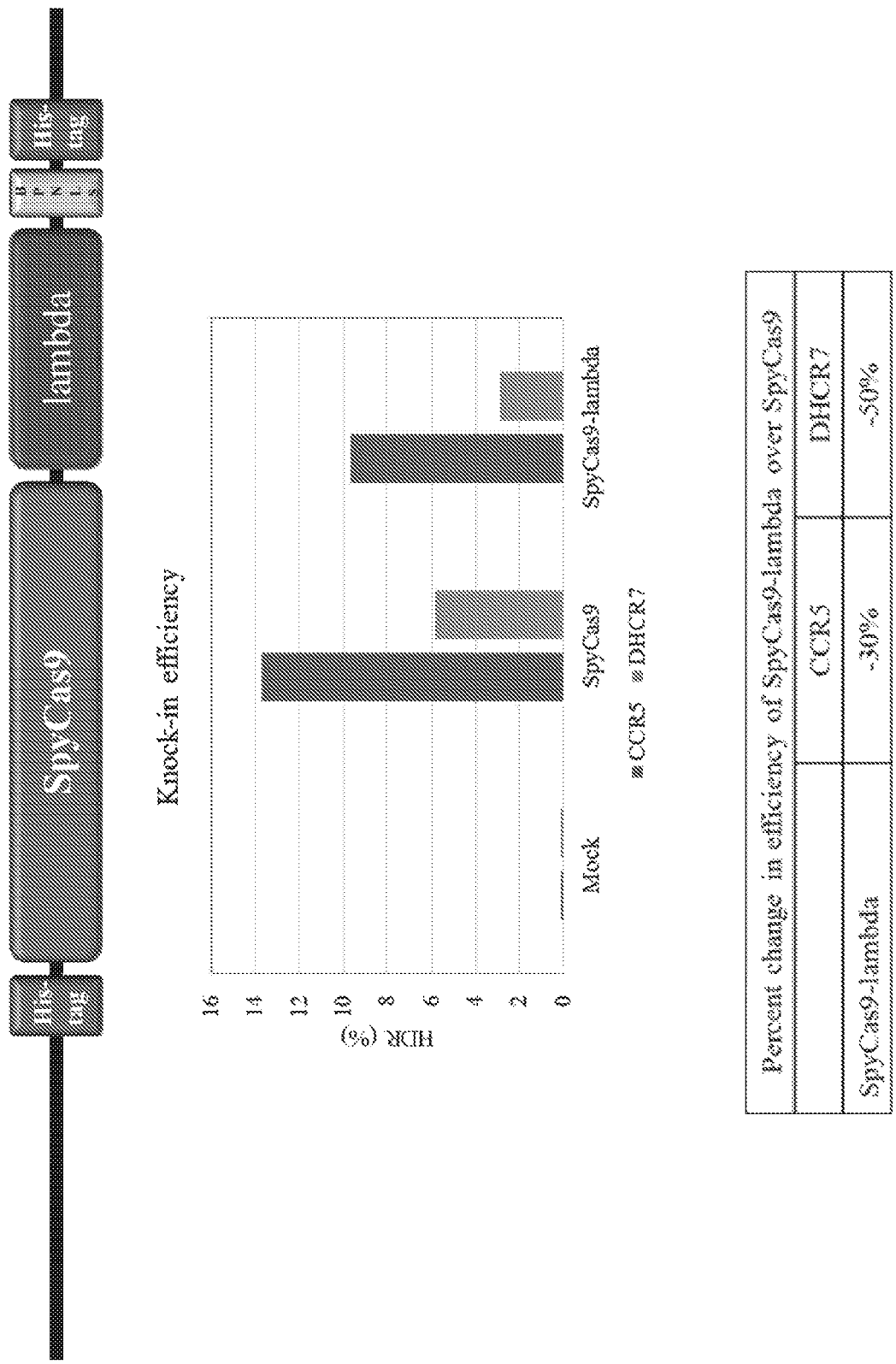

FIG. 84 illustrates a comparison of knock-in efficiencies between SpyCas9 and SpyCas9-lambda. Shown at top is a schematic of SpyCas9-lambda construct. Shown in the middle is a graph of editing efficiency at mock, SpyCas9, and SpyCas9-lambda treatment. Shown at the bottom is a table providing the percent change in efficiency of SpyCas9-lambda over SpyCas9.

Figure 85:
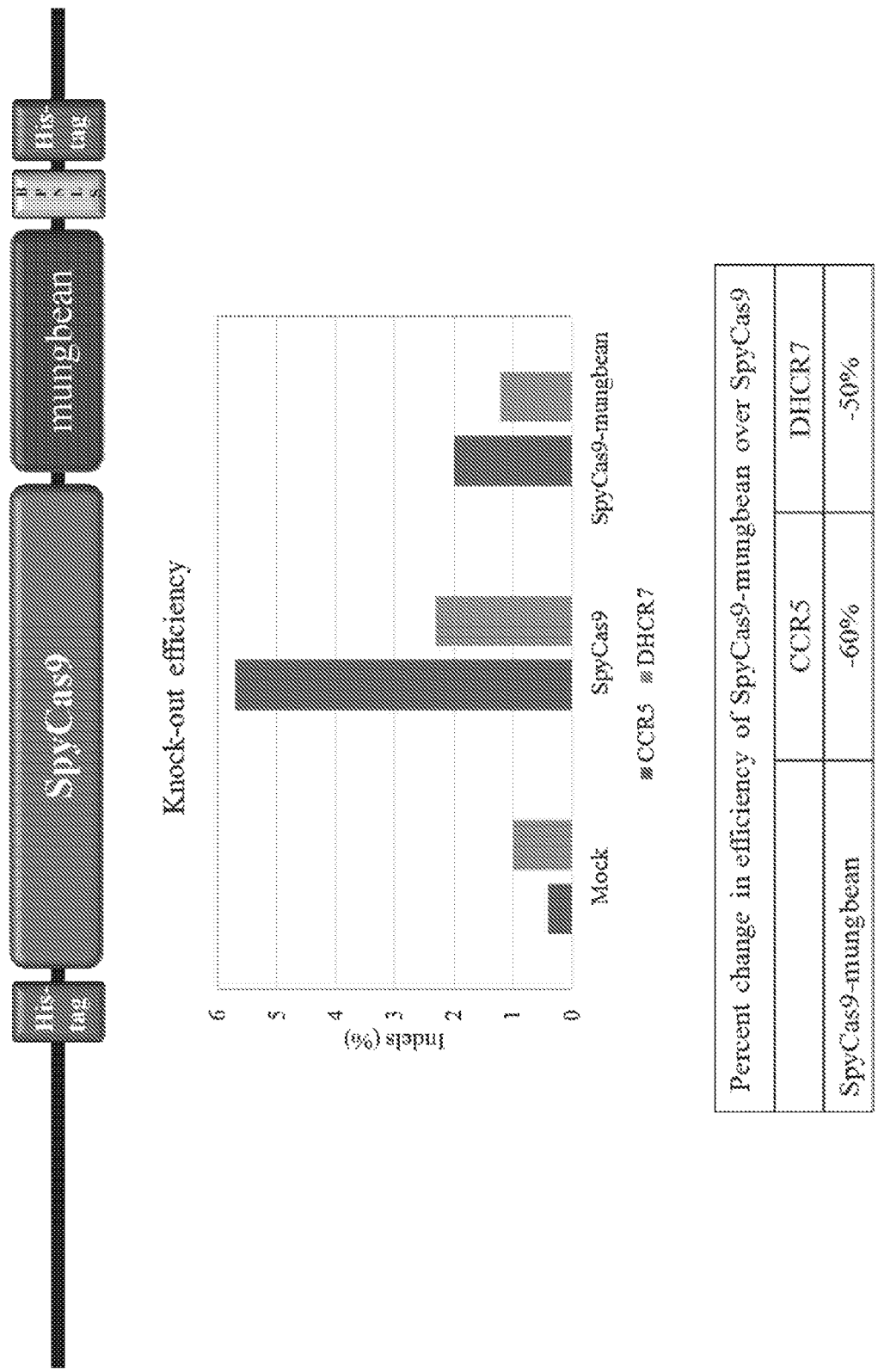

FIG. 85 illustrates a comparison of knock-out efficiencies between SpyCas9 and SpyCas9-mungbean. Shown at top is a schematic of SpyCas9-mungbean construct. Shown in the middle is a graph of editing efficiency at mock, SpyCas9, and SpyCas9-mungbean treatment. Shown at the bottom is a table providing the percent change in efficiency of SpyCas9-mungbean over SpyCas9.

Figure 86:
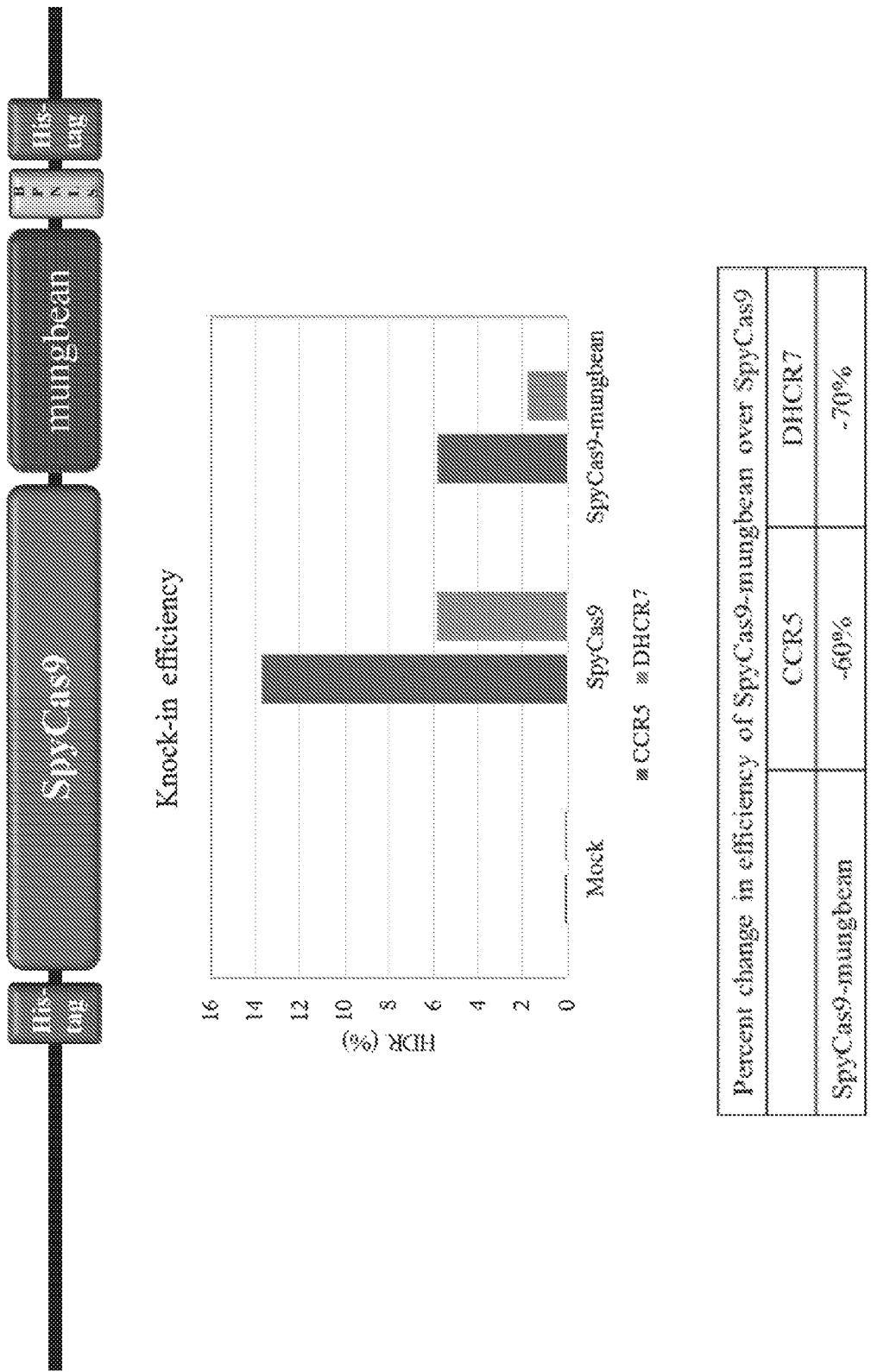

FIG. 86 illustrates a comparison of knock-in efficiencies between SpyCas9 and SpyCas9-mungbean. Shown at top is a schematic of SpyCas9-mungbean construct. Shown in the middle is a graph of editing efficiency at mock, SpyCas9, and SpyCas9-mungbean treatment. Shown at the bottom is a table providing the percent change in efficiency of SpyCas9-mungbean over SpyCas9.

Figure 87:
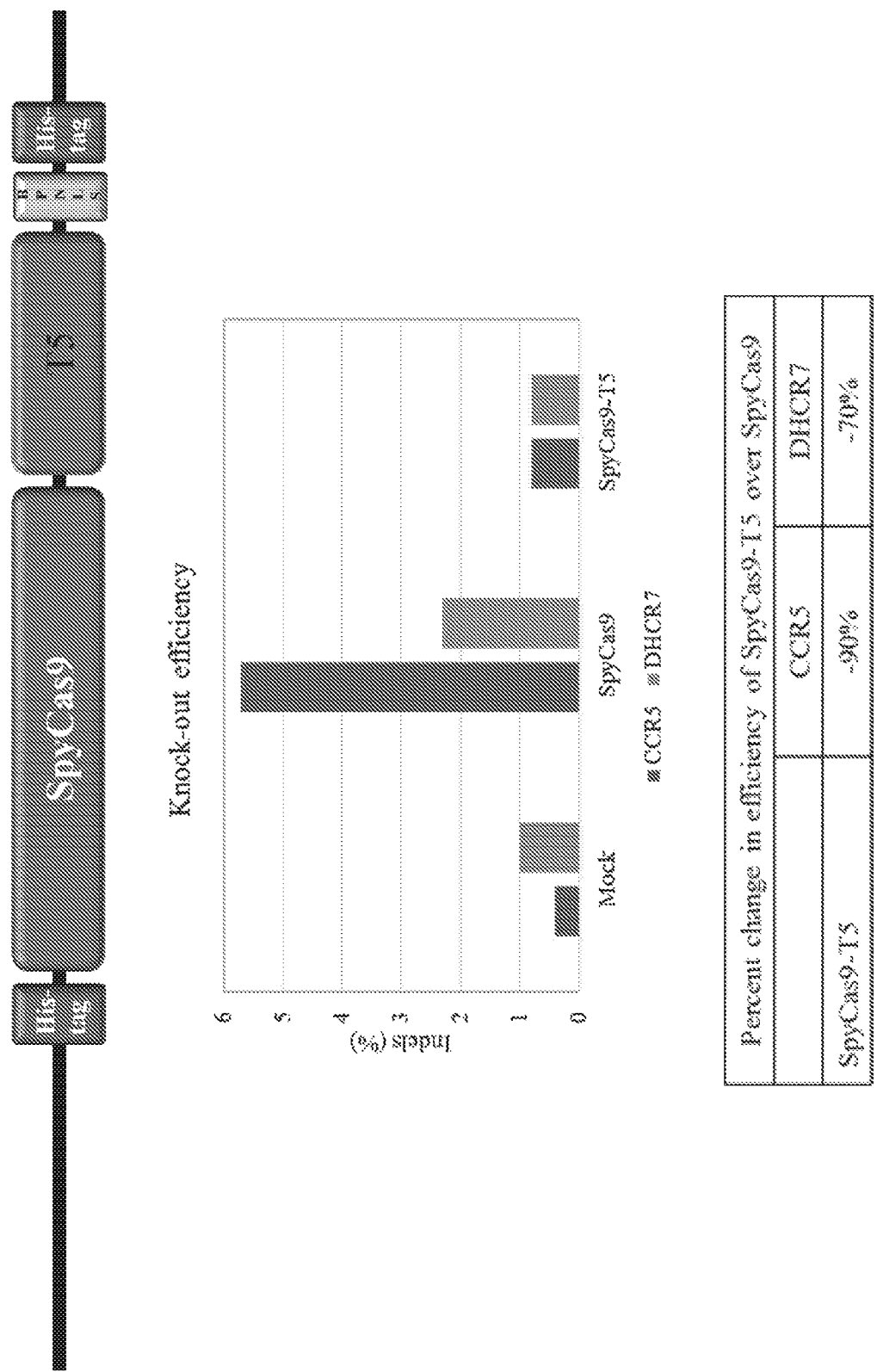

FIG. 87 illustrates a comparison of knock-out efficiencies between SpyCas9 and SpyCas9-T5. Shown at top is a schematic of SpyCas9-T5 construct. Shown in the middle is a graph of editing efficiency at mock, SpyCas9, and SpyCas9-T5 treatment. Shown at the bottom is a table providing the percent change in efficiency of SpyCas9-T5 over SpyCas9.

Figure 88:
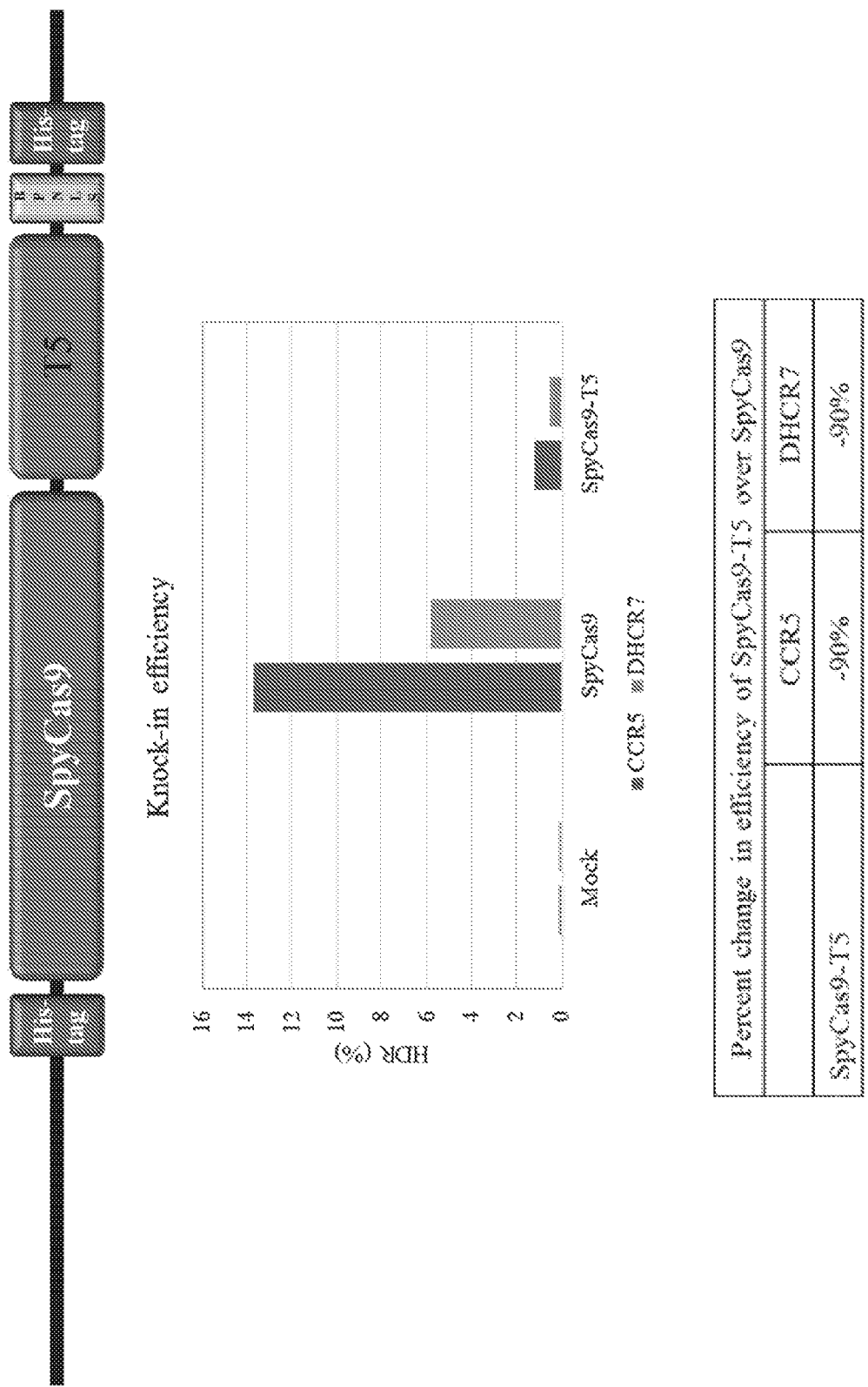

FIG. 88 illustrates a comparison of knock-in efficiencies between SpyCas9 and SpyCas9-T5. Shown at top is a schematic of SpyCas9-T5 construct. Shown in the middle is a graph of editing efficiency at mock, SpyCas9, and SpyCas9-T5 treatment. Shown at the bottom is a table providing the percent change in efficiency of SpyCas9-T5 over SpyCas9.

FIG. 89 illustrates editing efficiency comparison between SpyCas9 and SpyCas9 fusion proteins at N-terminus or both termini. SpyCas9 and SpyCas9 fusion proteins at N-terminus [exonucleases such as RecJ and RecE, GFP, single stranded DNA binding protein (SSB), and double stranded DNA binding protein (DSB)] show different genome editing efficiency. Shown at the left is knock-out efficiency as measured by percent indels for each group. Shown at the right is knock-in efficiency as measured by percent homology directed repair (HDR) for each group.

Figure 90:
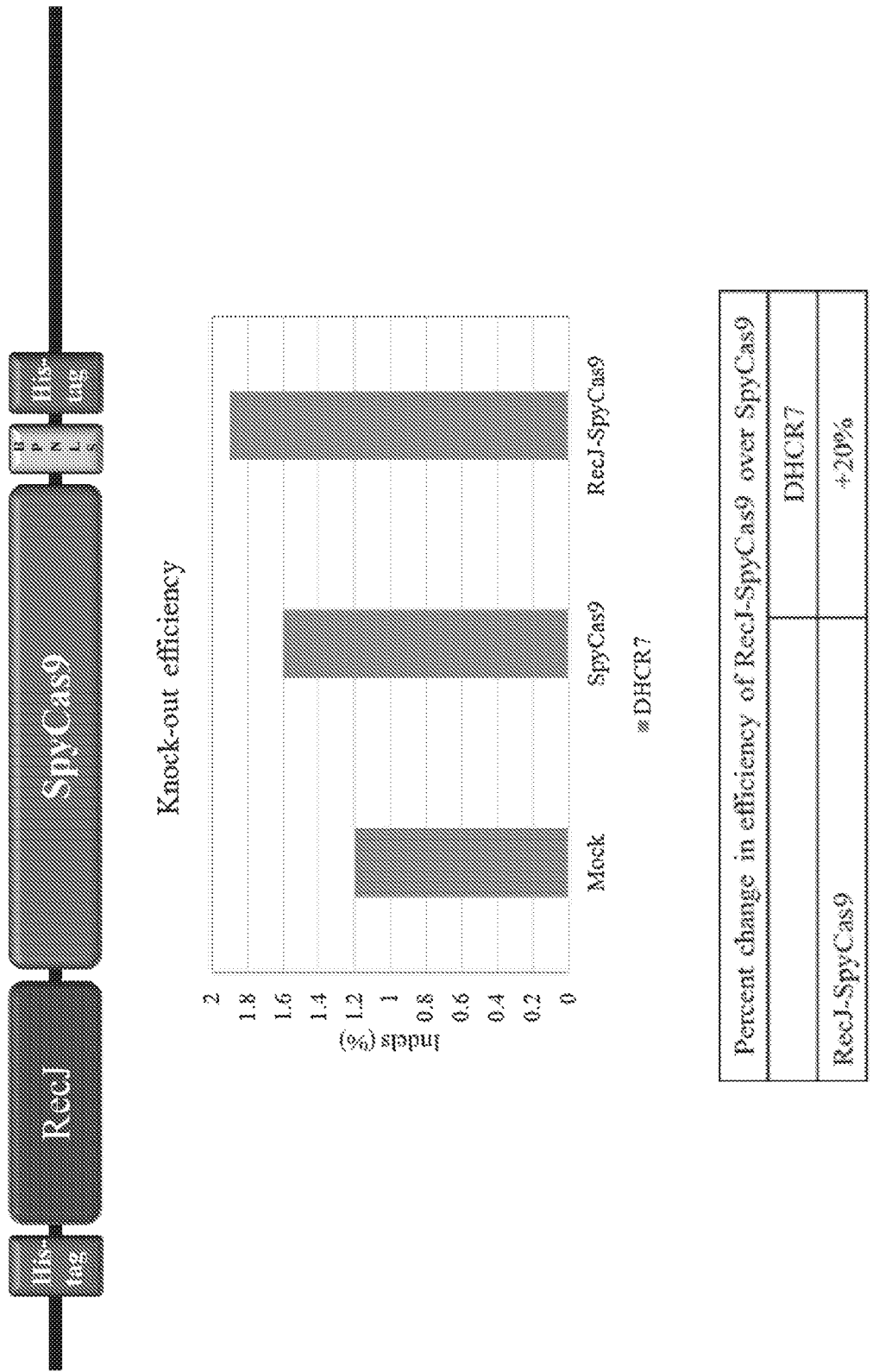

FIG. 90 illustrates a comparison of knock-out efficiencies between SpyCas9 and RecJ-SpyCas9. Shown at top is a schematic of RecJ-SpyCas9 construct. Shown in the middle is a graph of editing efficiency at mock, SpyCas9, and RecJ-SpyCas9 treatment. Shown at the bottom is a table providing the percent change in efficiency of RecJ-SpyCas9 over SpyCas9.

Figure 91:
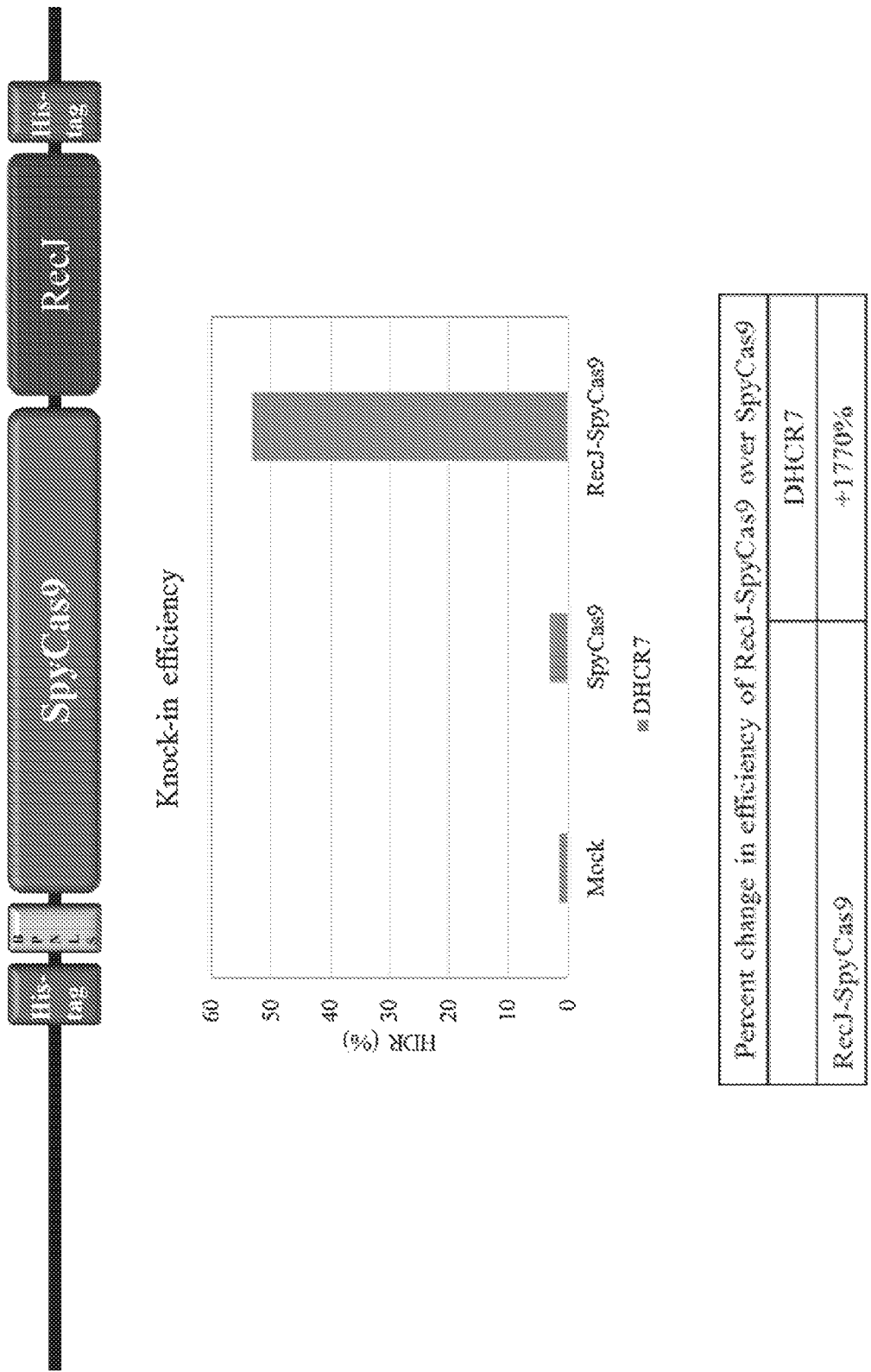

FIG. 91 illustrates a comparison of knock-in efficiencies between SpyCas9 and RecJ-SpyCas9. Shown at top is a schematic of RecJ-SpyCas9 construct. Shown in the middle is a graph of editing efficiency at mock, SpyCas9, and RecJ-SpyCas9 treatment. Shown at the bottom is a table providing the percent change in efficiency of RecJ-SpyCas9 over SpyCas9.

Figure 92:
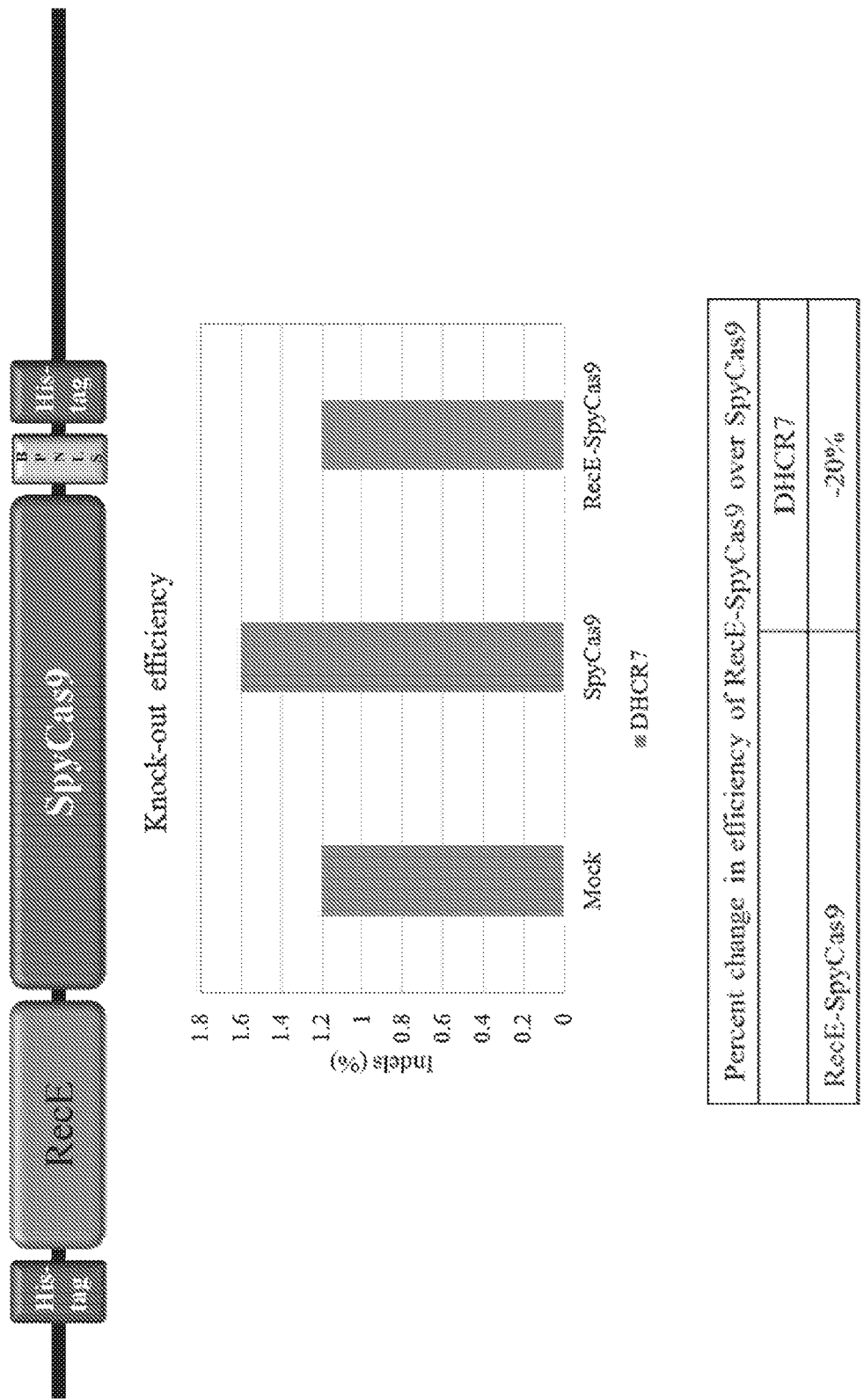

FIG. 92 illustrates a comparison of knock-out efficiencies between SpyCas9 and RecE-SpyCas9. Shown at top is a schematic of RecE-SpyCas9 construct. Shown in the middle is a graph of editing efficiency at mock, SpyCas9, and RecE-SpyCas9 treatment. Shown at the bottom is a table providing the percent change in efficiency of RecE-SpyCas9 over SpyCas9.

Figure 93:
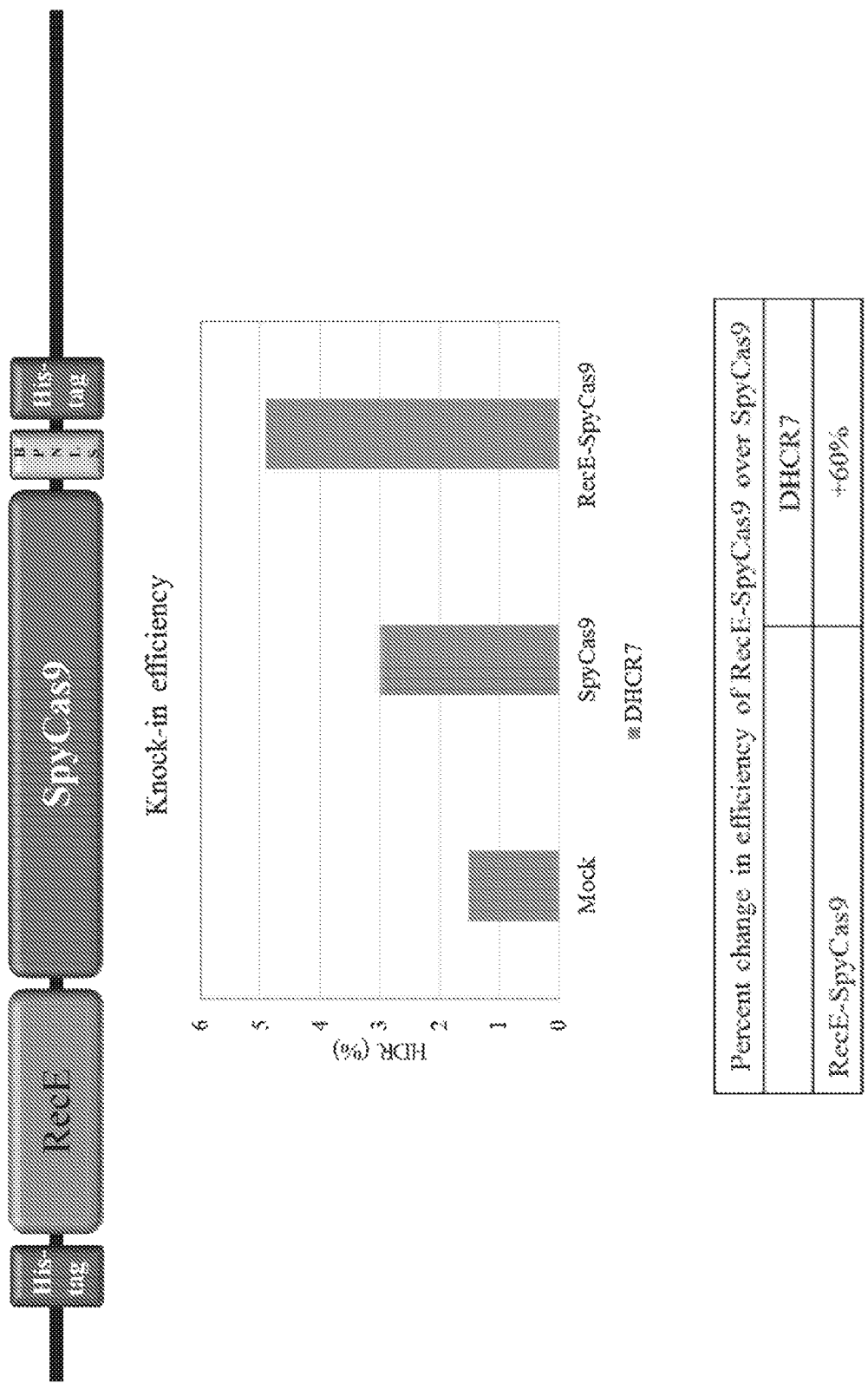

FIG. 93 illustrates a comparison of knock-in efficiencies between SpyCas9 and RecE-SpyCas9. Shown at top is a schematic of RecE-SpyCas9 construct. Shown in the middle is a graph of editing efficiency at mock, SpyCas9, and RecE-SpyCas9 treatment. Shown at the bottom is a table providing the percent change in efficiency of RecE-SpyCas9 over SpyCas9.

Figure 94:
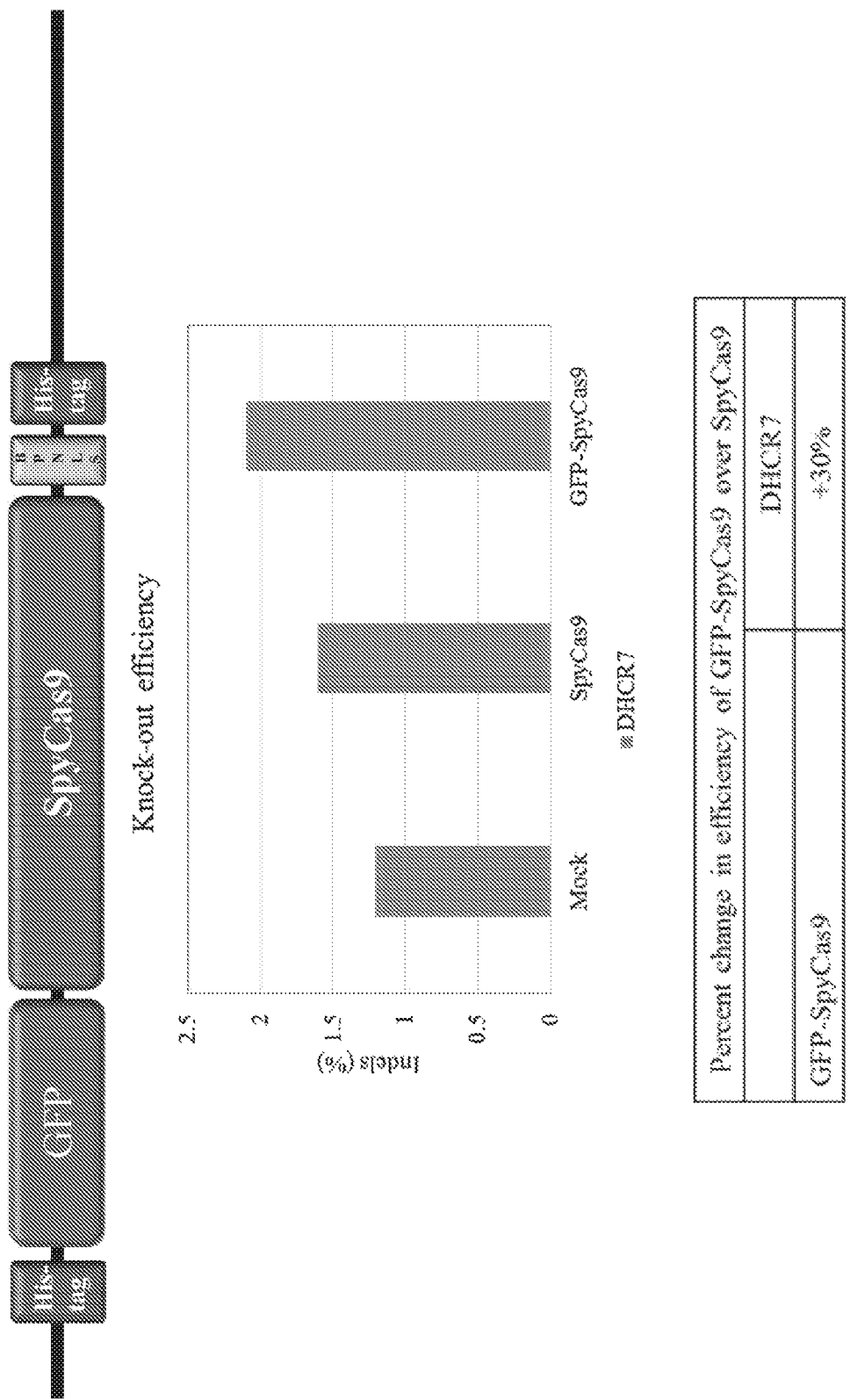

FIG. 94 illustrates a comparison of knock-out efficiencies between SpyCas9 and GFP-SpyCas9. Shown at top is a schematic of GFP-SpyCas9 construct. Shown in the middle is a graph of editing efficiency at mock, SpyCas9, and GFP-SpyCas9 treatment. Shown at the bottom is a table providing the percent change in efficiency of GFP-SpyCas9 over SpyCas9.

Figure 95:
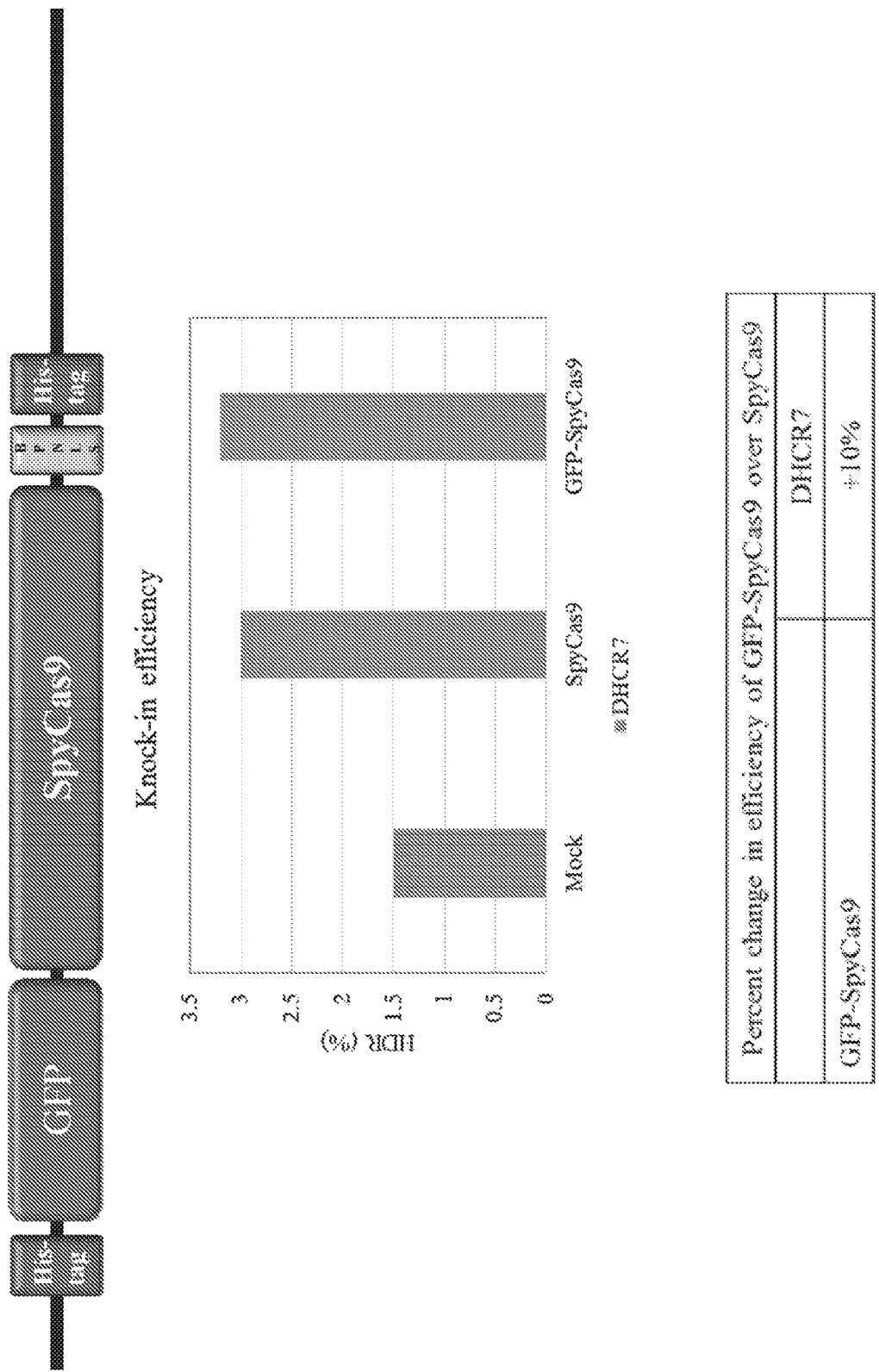

FIG. 95 illustrates a comparison of knock-in efficiencies between SpyCas9 and GFP-SpyCas9. Shown at top is a schematic of GFP-SpyCas9 construct. Shown in the middle is a graph of editing efficiency at mock, SpyCas9, and GFP-SpyCas9 treatment. Shown at the bottom is a table providing the percent change in efficiency of GFP-SpyCas9 over SpyCas9.

Figure 96:
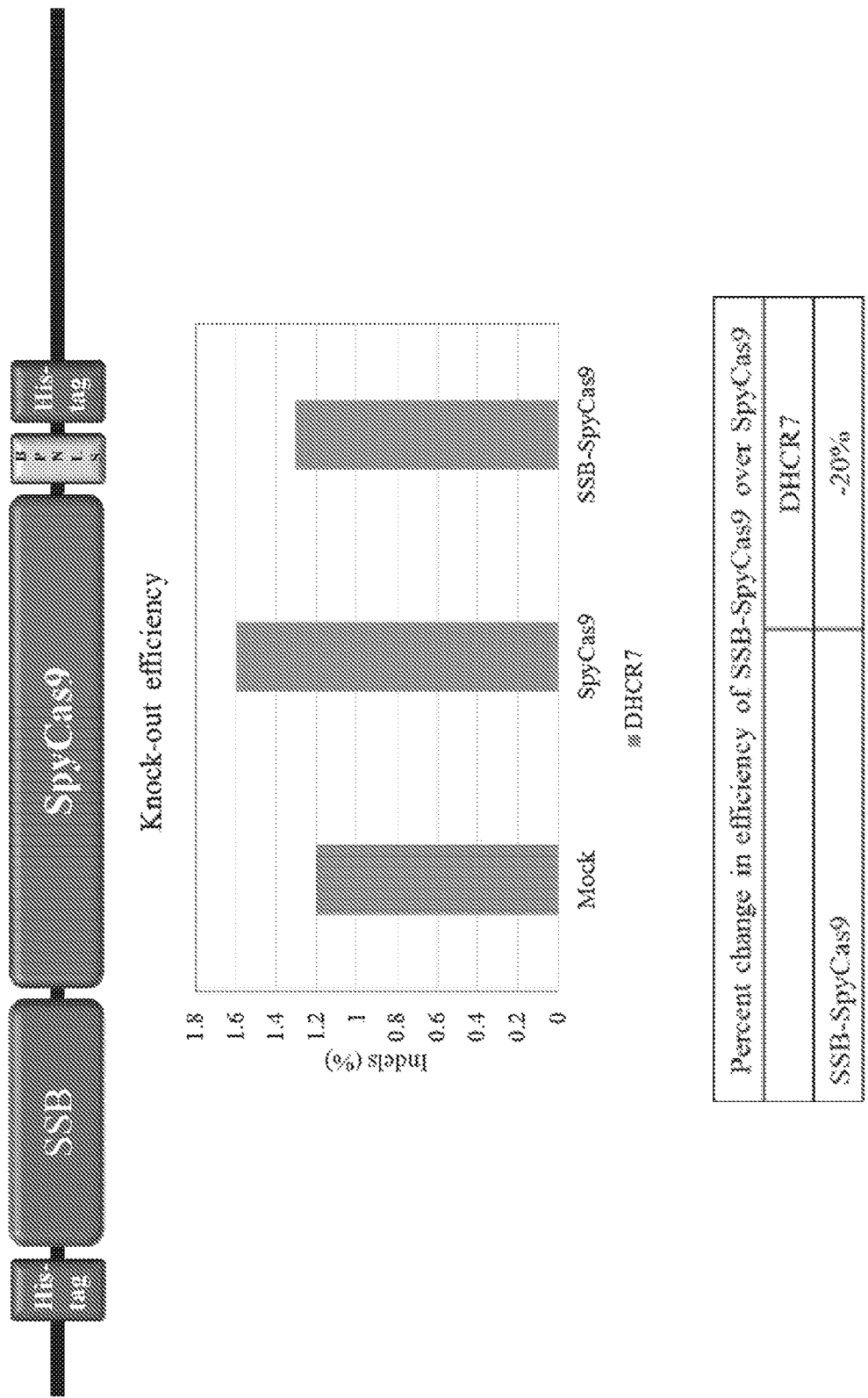

FIG. 96 illustrates a comparison of knock-out efficiencies between SpyCas9 and SSB-SpyCas9. Shown at top is a schematic of SSB-SpyCas9 construct. Shown in the middle is a graph of editing efficiency at mock, SpyCas9, and SSB-SpyCas9 treatment. Shown at the bottom is a table providing the percent change in efficiency of SSB-SpyCas9 over SpyCas9.

Figure 97:
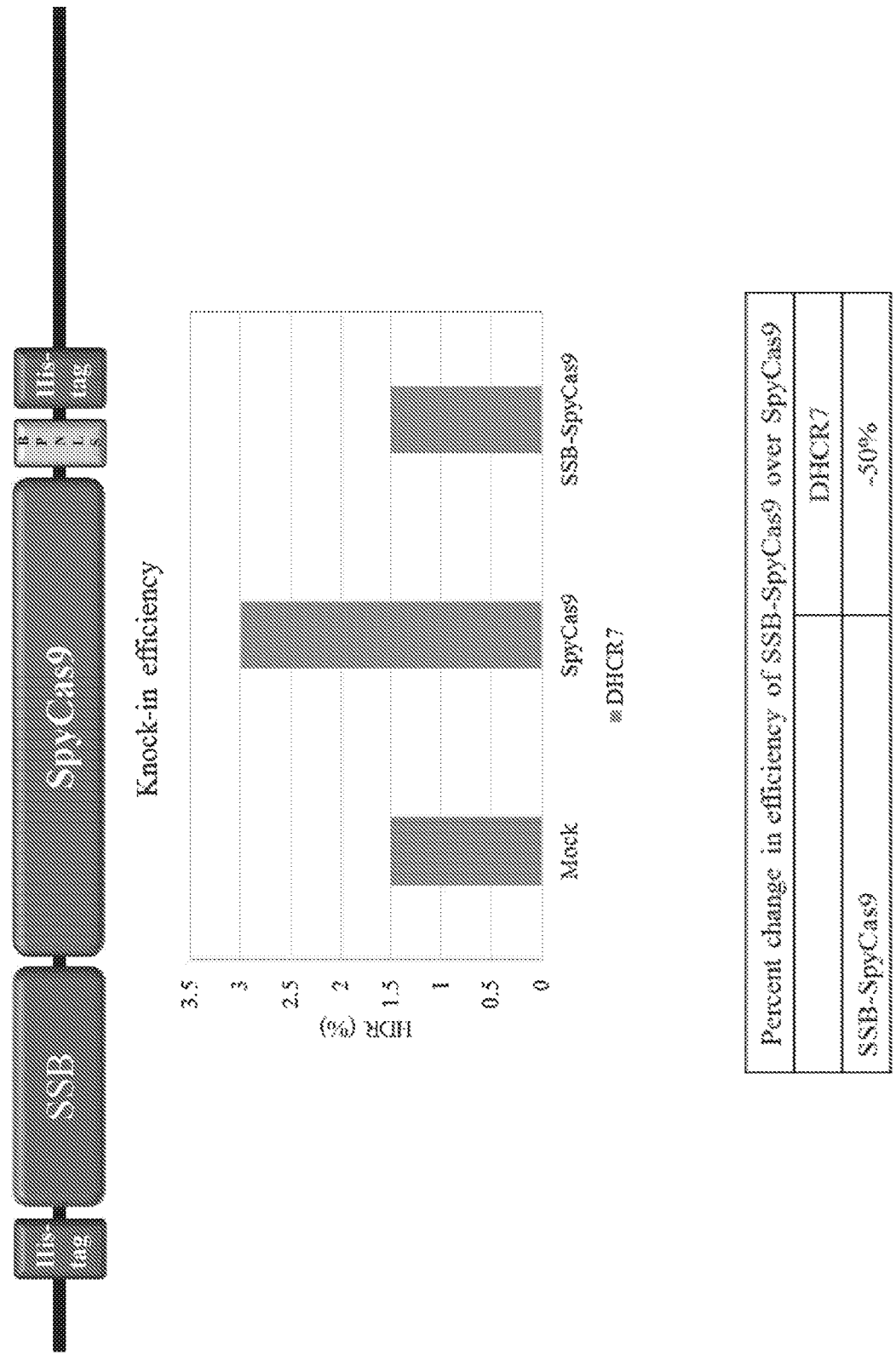

FIG. 97 illustrates a comparison of knock-in efficiencies between SpyCas9 and SSB-SpyCas9. Shown at top is a schematic of SSB-SpyCas9 construct. Shown in the middle is a graph of editing efficiency at mock, SpyCas9, and SSB-SpyCas9 treatment. Shown at the bottom is a table providing the percent change in efficiency of SSB-SpyCas9 over SpyCas9.

Figure 98:
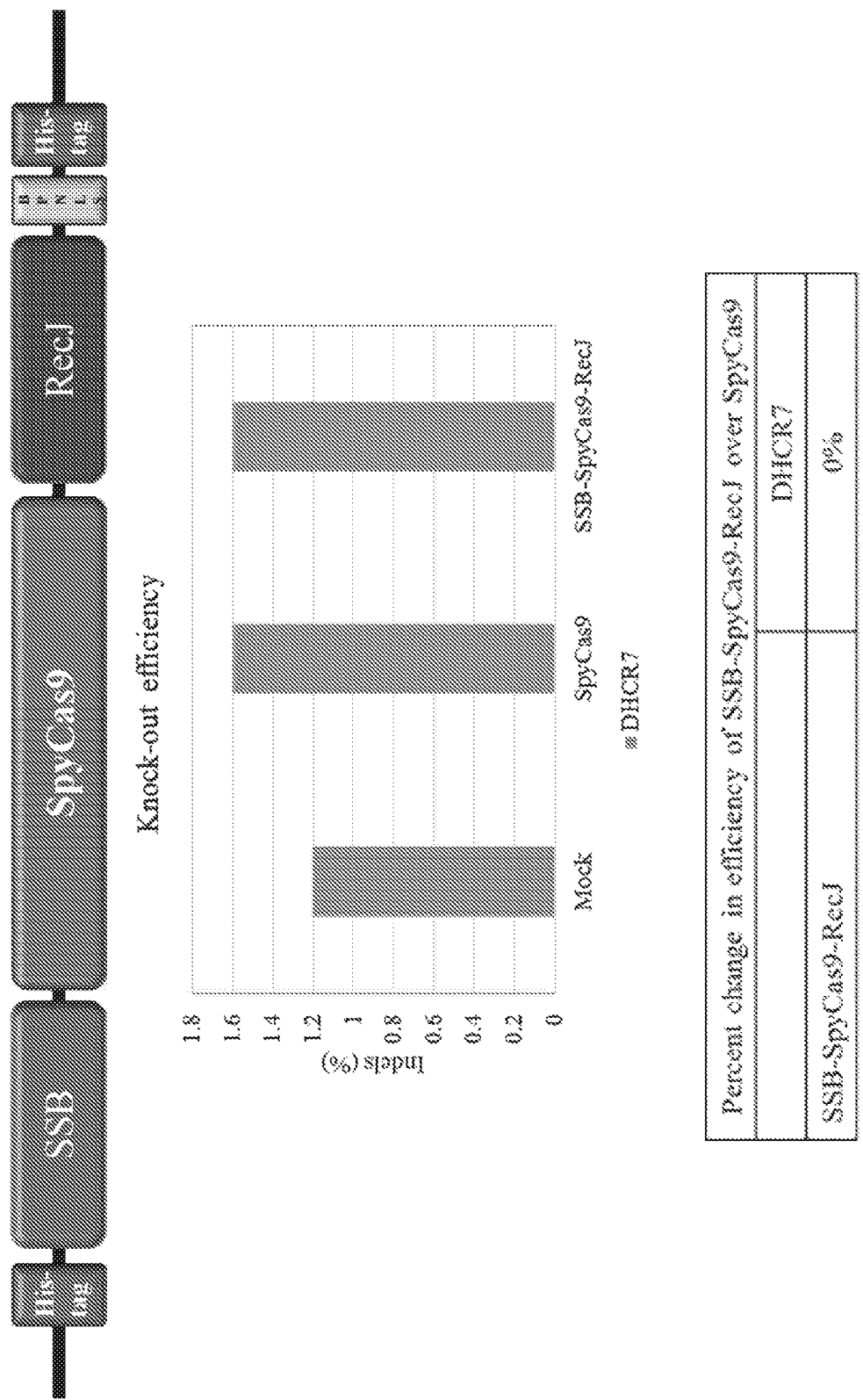

FIG. 98 illustrates a comparison of knock-out efficiencies between SpyCas9 and SSB-SpyCas9-RecJ. Shown at top is a schematic of SSB-SpyCas9-RecJ construct. Shown in the middle is a graph of editing efficiency at mock, SpyCas9, and SSB-SpyCas9-RecJ treatment. Shown at the bottom is a table providing the percent change in efficiency of SSB-SpyCas9-RecJ over SpyCas9.

Figure 99:
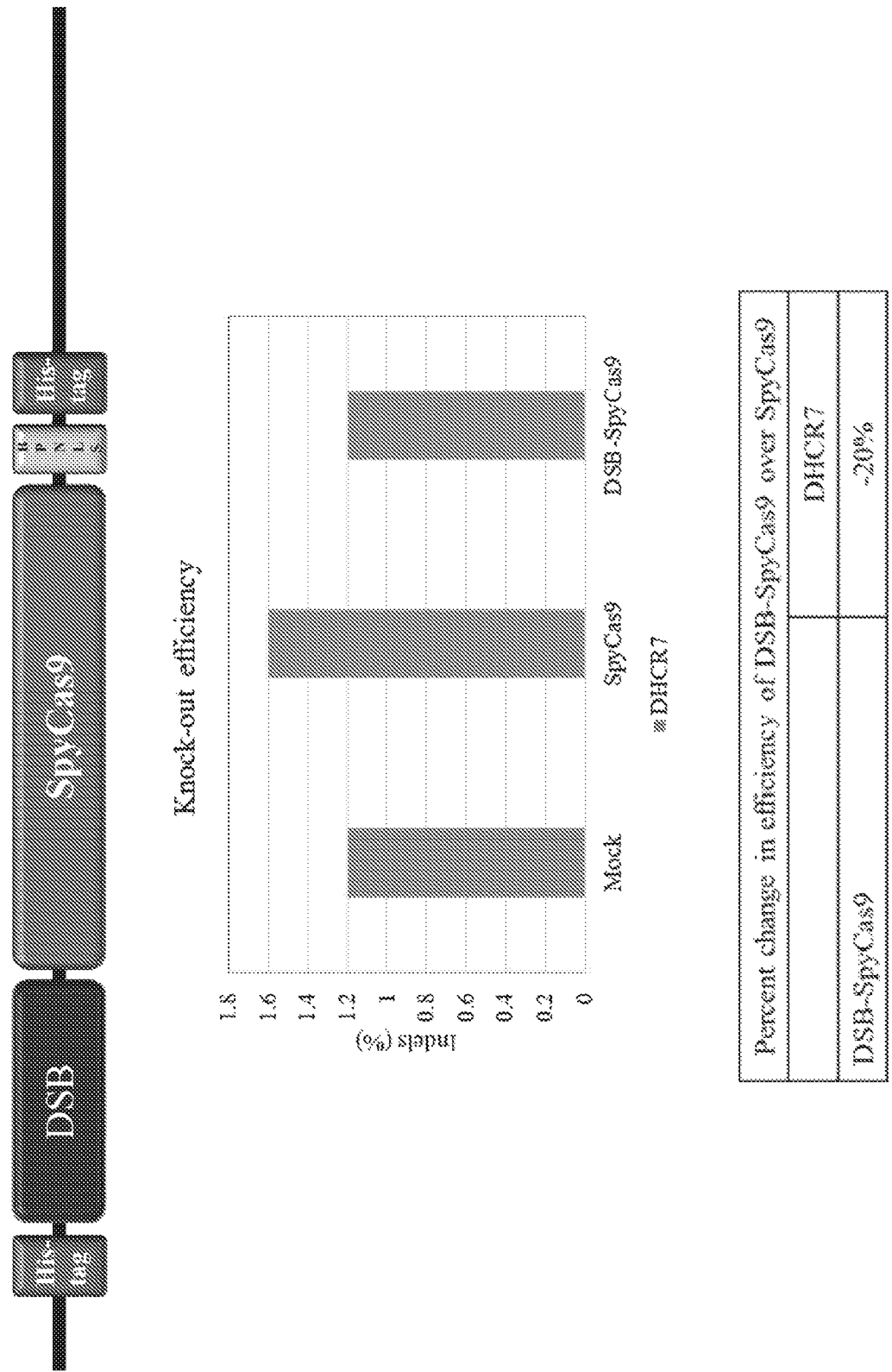

FIG. 99 illustrates a comparison of knock-out efficiencies between SpyCas9 and DSB-SpyCas9. Shown at top is a schematic of DSB-SpyCas9 construct. Shown in the middle is a graph of editing efficiency at mock, SpyCas9, and DSB-SpyCas9 treatment. Shown at the bottom is a table providing the percent change in efficiency of DSB-SpyCas9 over SpyCas9.

Figure 100:
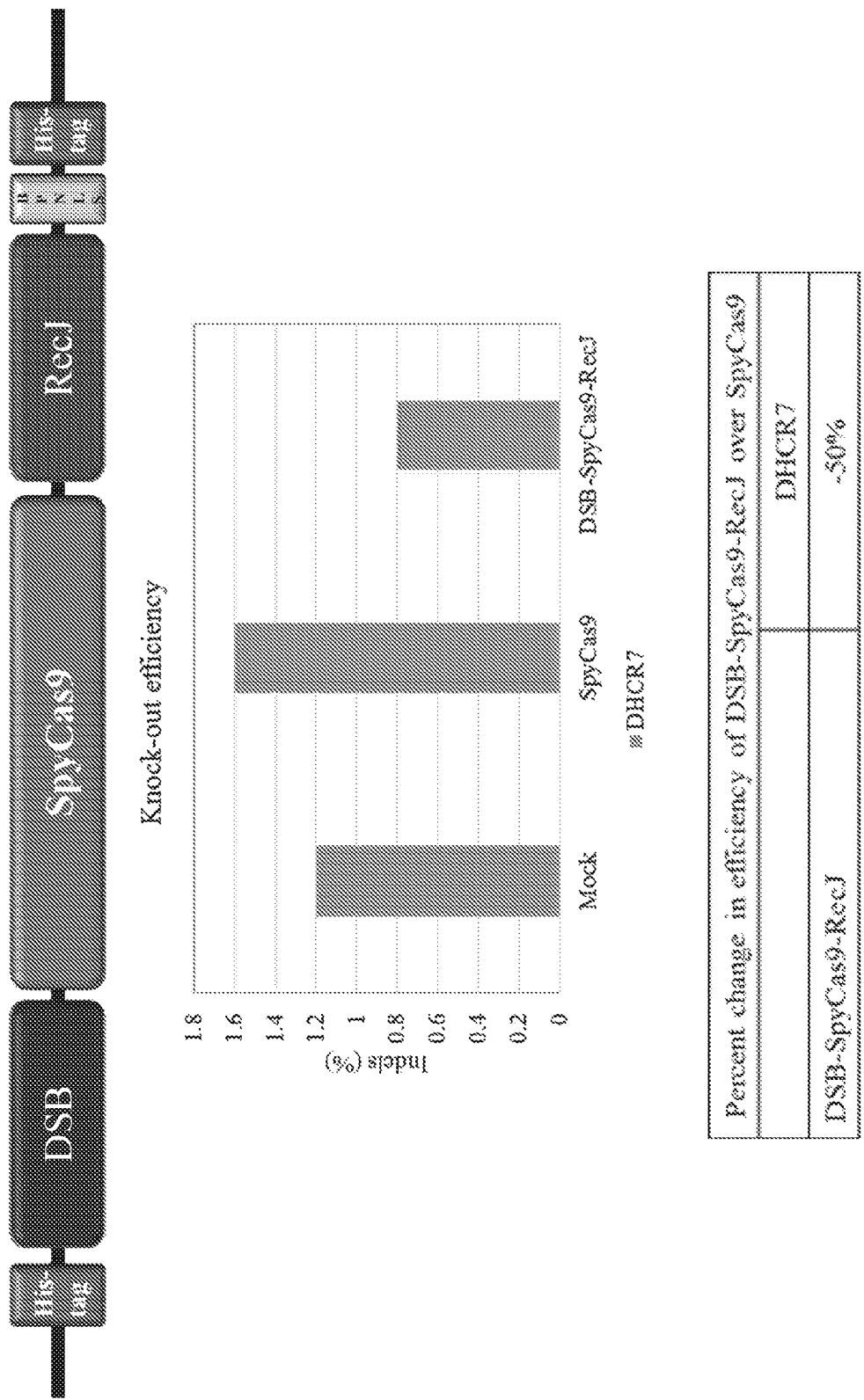

FIG. 100 illustrates a comparison of knock-out efficiencies between SpyCas9 and DSB-SpyCas9-RecJ. Shown at top is a schematic of DSB-SpyCas9-RecJ construct. Shown in the middle is a graph of editing efficiency at mock, SpyCas9, and DSB-SpyCas9-RecJ treatment. Shown at the bottom is a table providing the percent change in efficiency of DSB-SpyCas9-RecJ over SpyCas9.

Figure 101:
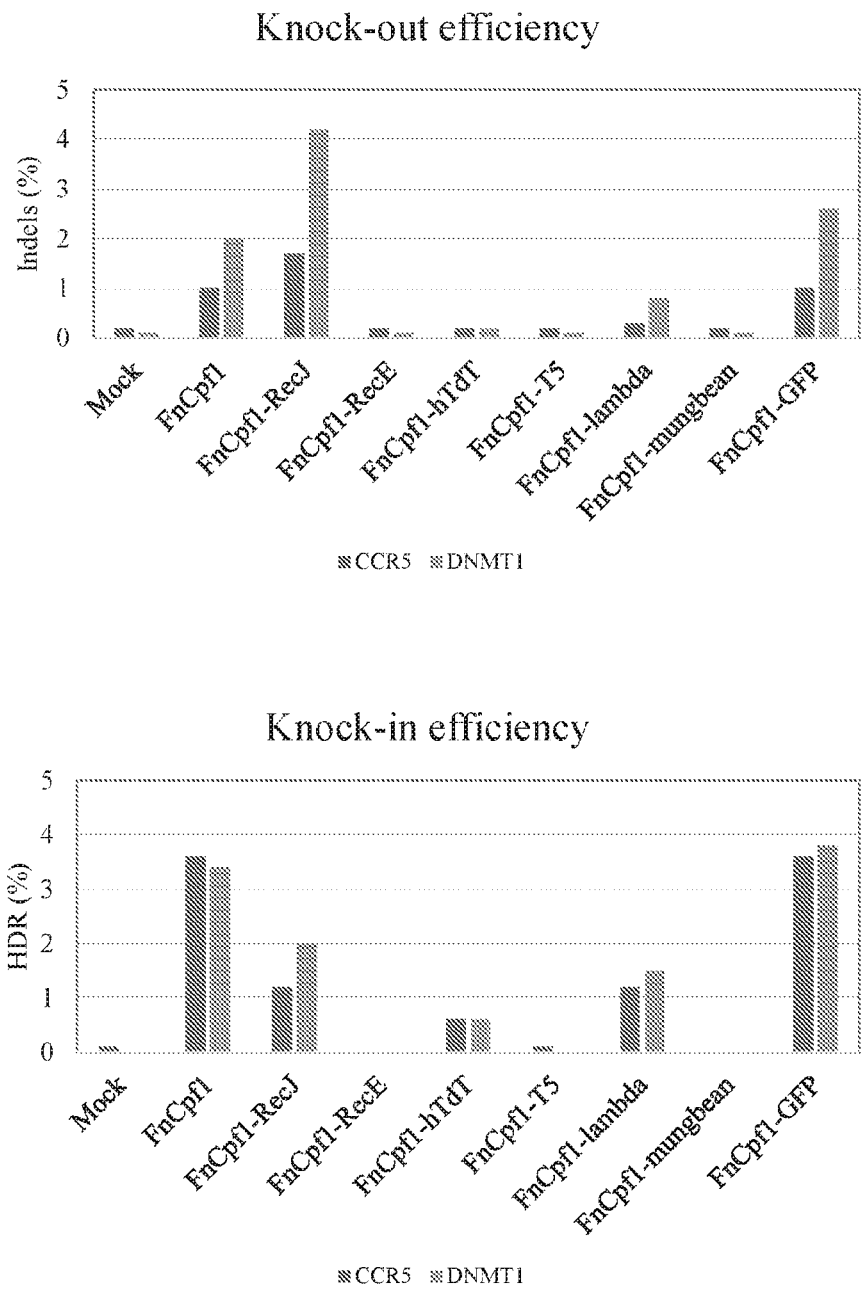

FIG. 101 illustrates editing efficiency comparison between FnCpf1 and C-terminal fusion proteins to FnCpf1. FnCpf1 and fusion proteins at C-terminus of FnCpf1 [exonucleases (RecJ, RecE, T5, lambda, and mungbean), hTdT, and GFP] show different genome editing efficiency. Shown at the left is a bar graph of knock-out efficiency as measured by percent indels for each group. Shown at the right is a bar graph of knock-in efficiency as measured by percent homology directed repair (HDR) for each group.

Figure 102:
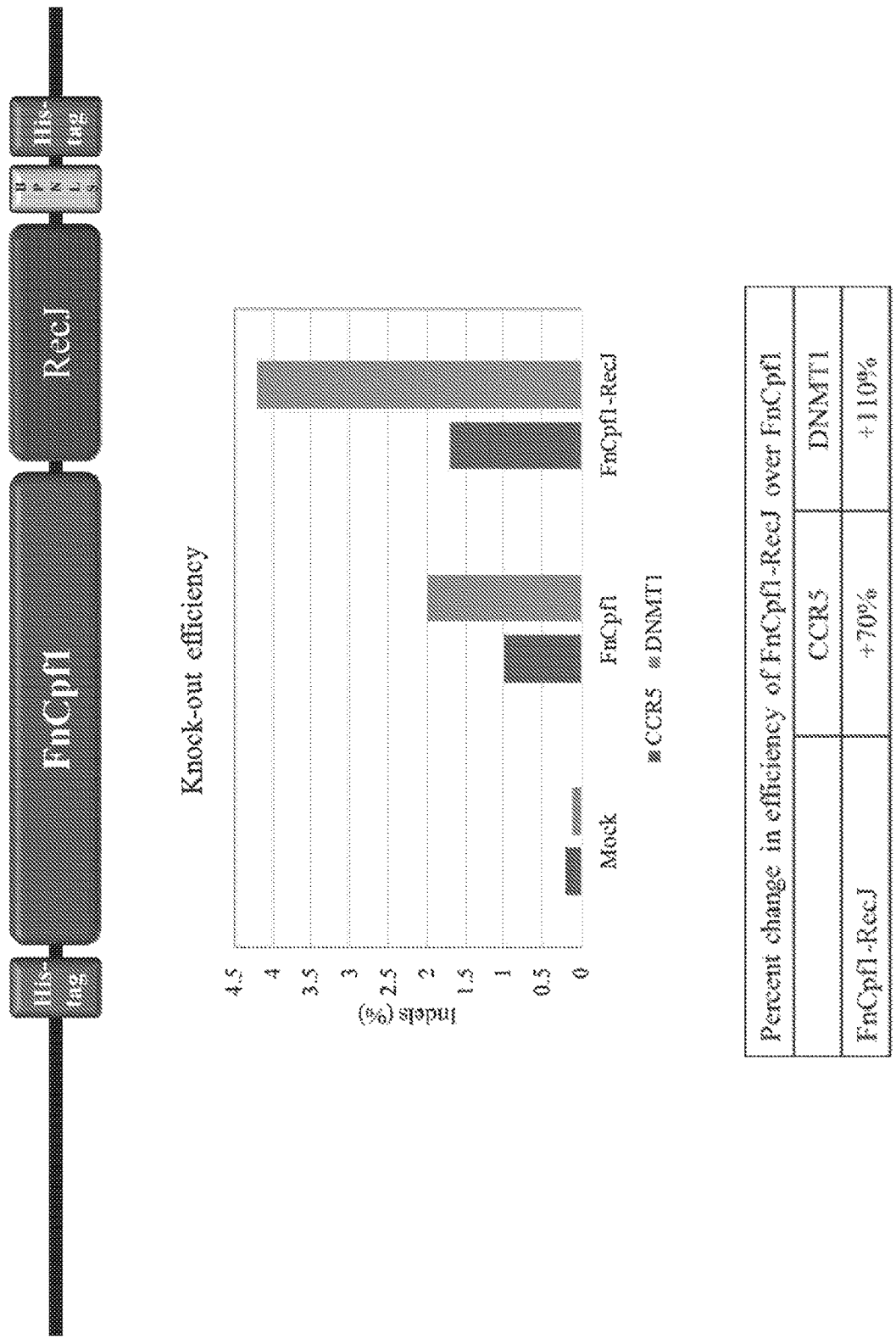

FIG. 102 illustrates a comparison of knock-out efficiencies between FnCpf1 and FnCpf1-RecJ. Shown at top is a schematic of FnCpf1-RecJ construct. Shown in the middle is a graph of editing efficiency at mock, FnCpf1, and FnCpf1-RecJ treatment. Shown at the bottom is a table providing the percent change in efficiency of FnCpf1-RecJ over FnCpf1.

Figure 103:
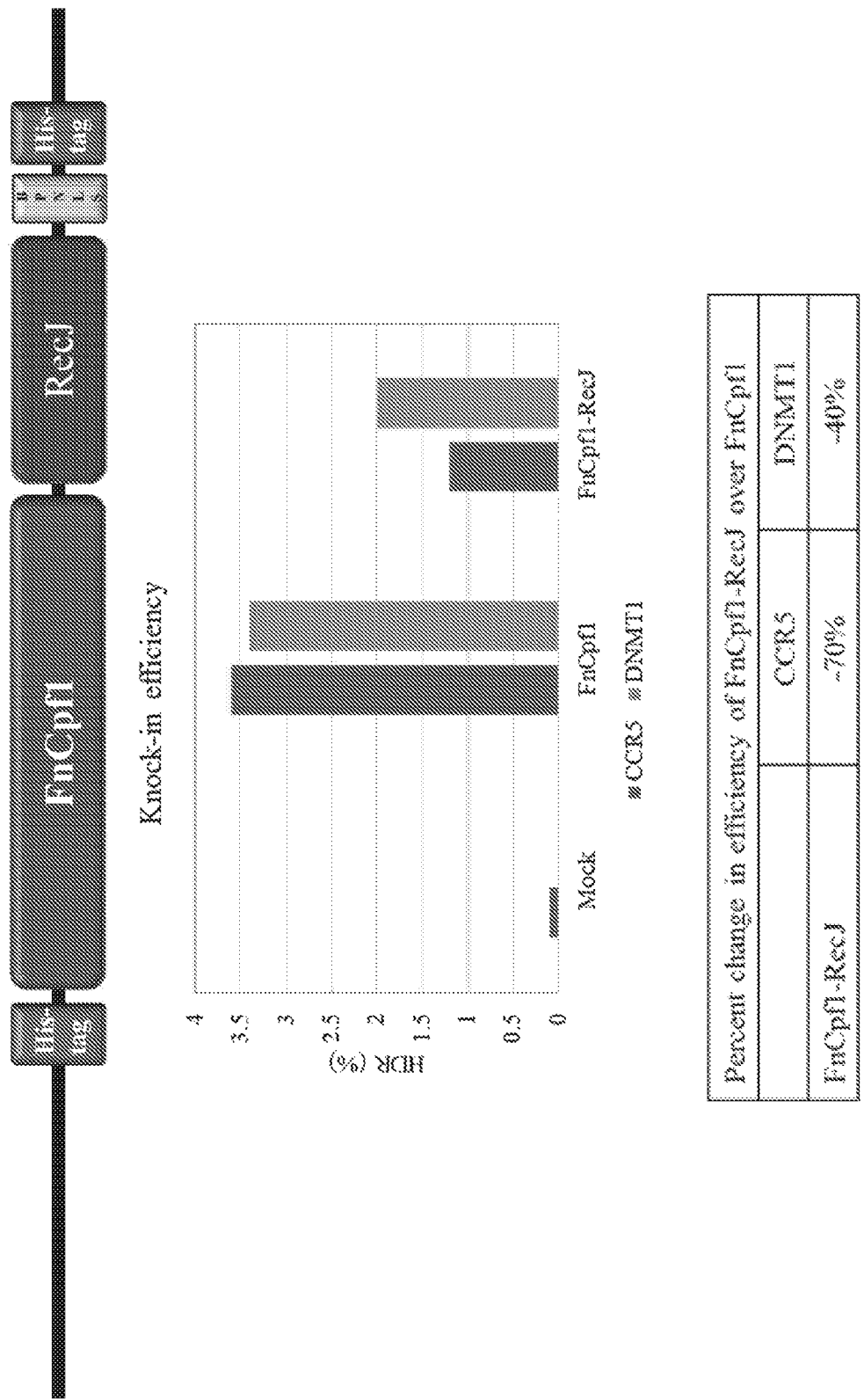

FIG. 103 illustrates a comparison of knock-in efficiencies between FnCpf1 and FnCpf1-RecJ. Shown at top is a schematic of FnCpf1-RecJ construct. Shown in the middle is a graph of editing efficiency at mock, FnCpf1, and FnCpf1-RecJ treatment. Shown at the bottom is a table providing the percent change in efficiency of FnCpf1-RecJ over FnCpf1.

Figure 104:
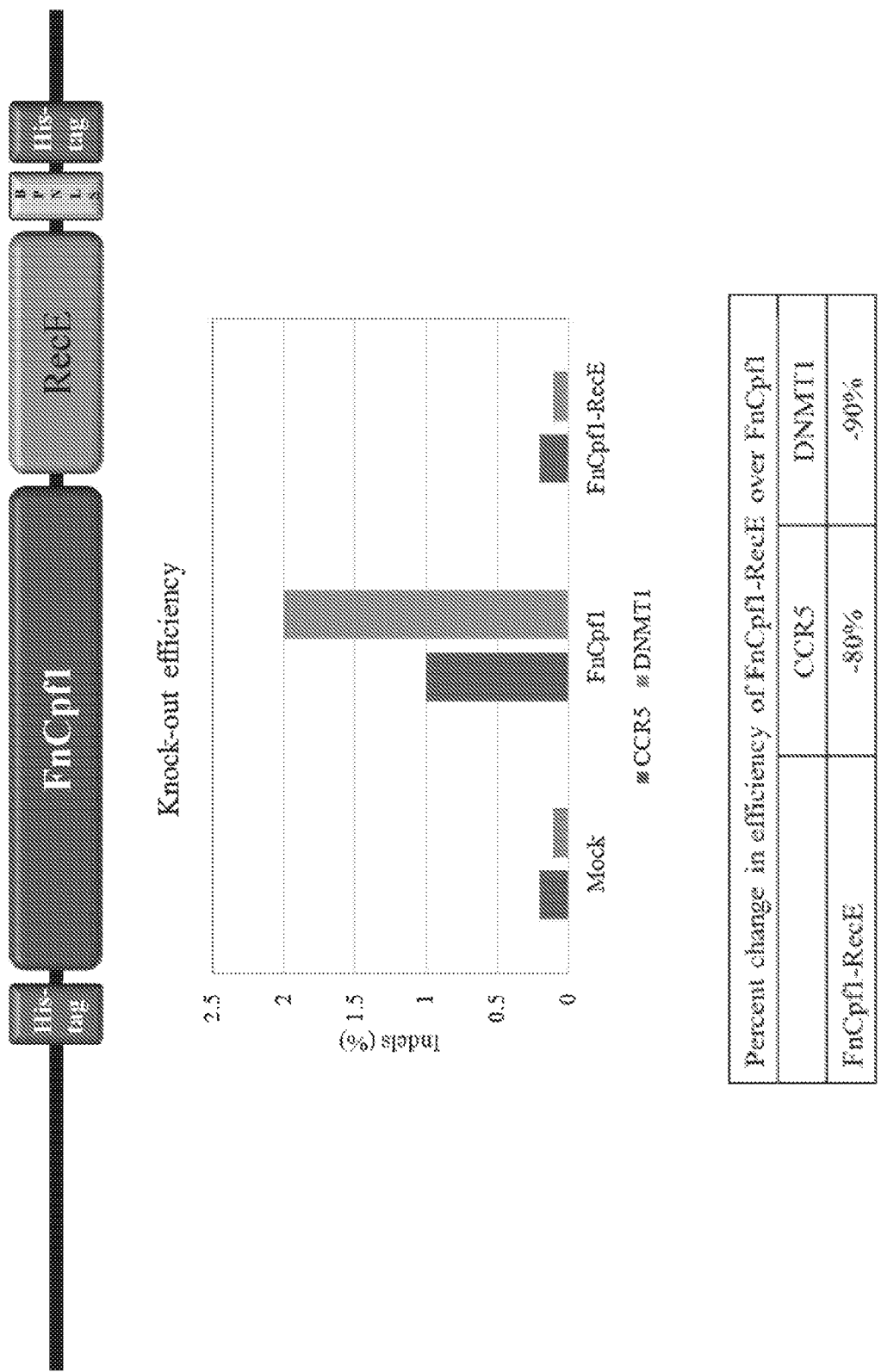

FIG. 104 illustrates a comparison of knock-out efficiencies between FnCpf1 and FnCpf1-RecE. Shown at top is a schematic of FnCpf1-RecE construct. Shown in the middle is a graph of editing efficiency at mock, FnCpf1, and FnCpf1-RecE treatment. Shown at the bottom is a table providing the percent change in efficiency of FnCpf1-RecE over FnCpf1.

Figure 105:
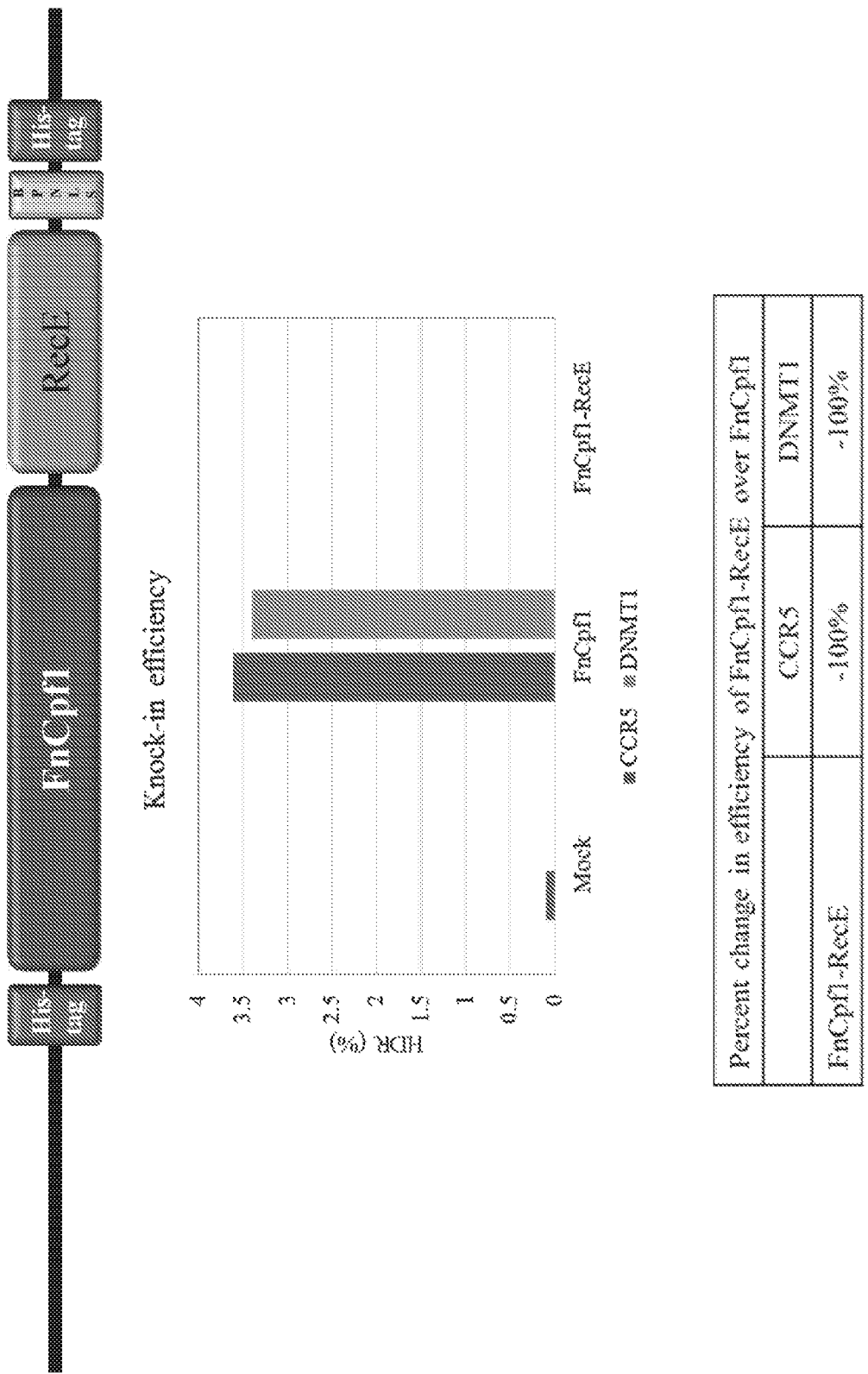

FIG. 105 illustrates a comparison of knock-in efficiencies between FnCpf1 and FnCpf1-RecE. Shown at top is a schematic of FnCpf1-RecE construct. Shown in the middle is a graph of editing efficiency at mock, FnCpf1, and FnCpf1-RecE treatment. Shown at the bottom is a table providing the percent change in efficiency of FnCpf1-RecE over FnCpf1.

Figure 106:
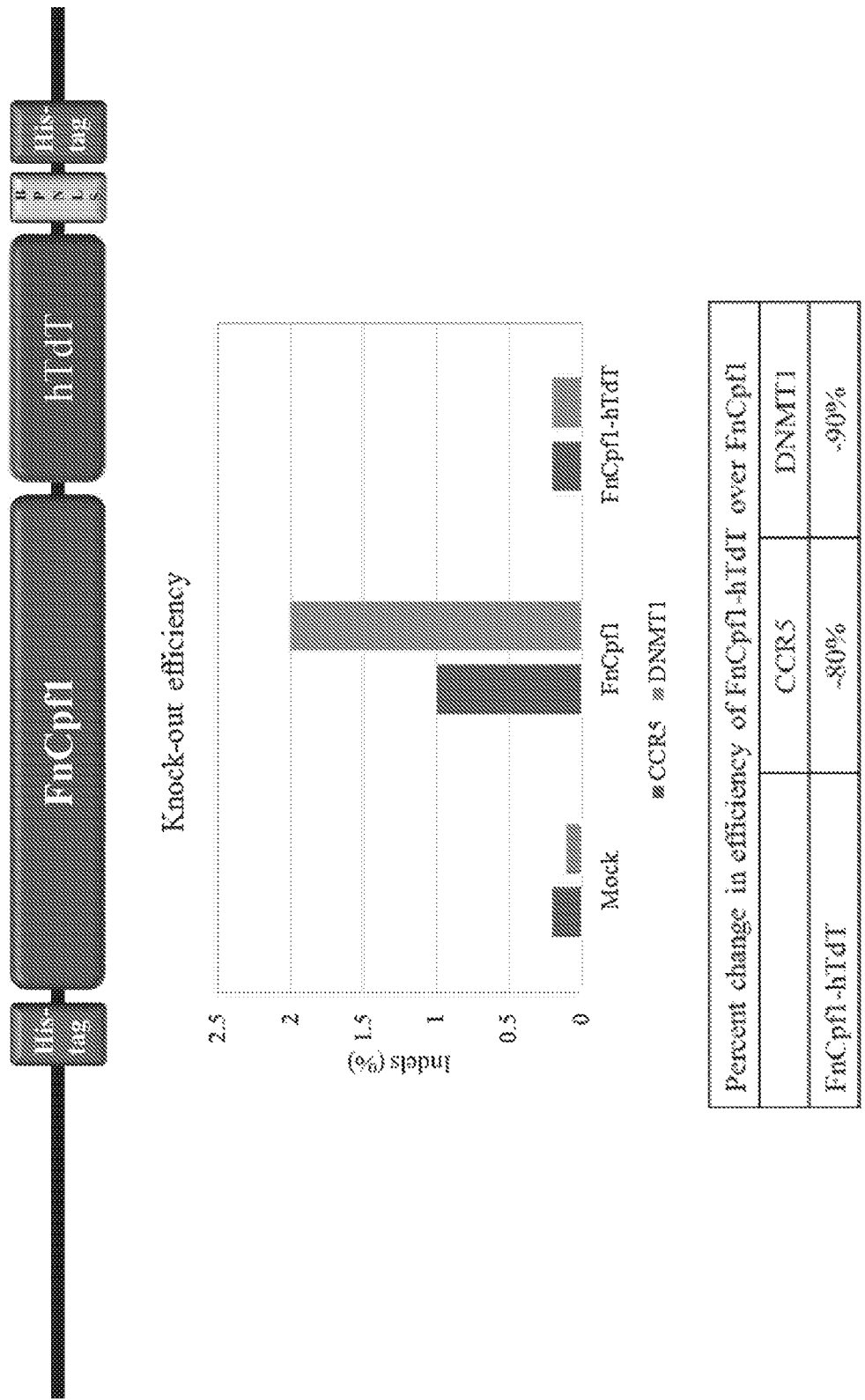

FIG. 106 illustrates a comparison of knock-out efficiencies between FnCpf1 and FnCpf1-hTdT. Shown at top is a schematic of FnCpf1-hTdT construct. Shown in the middle is a graph of editing efficiency at mock, FnCpf1, and FnCpf1-hTdT treatment. Shown at the bottom is a table providing the percent change in efficiency of FnCpf1-hTdT over FnCpf1.

Figure 107:
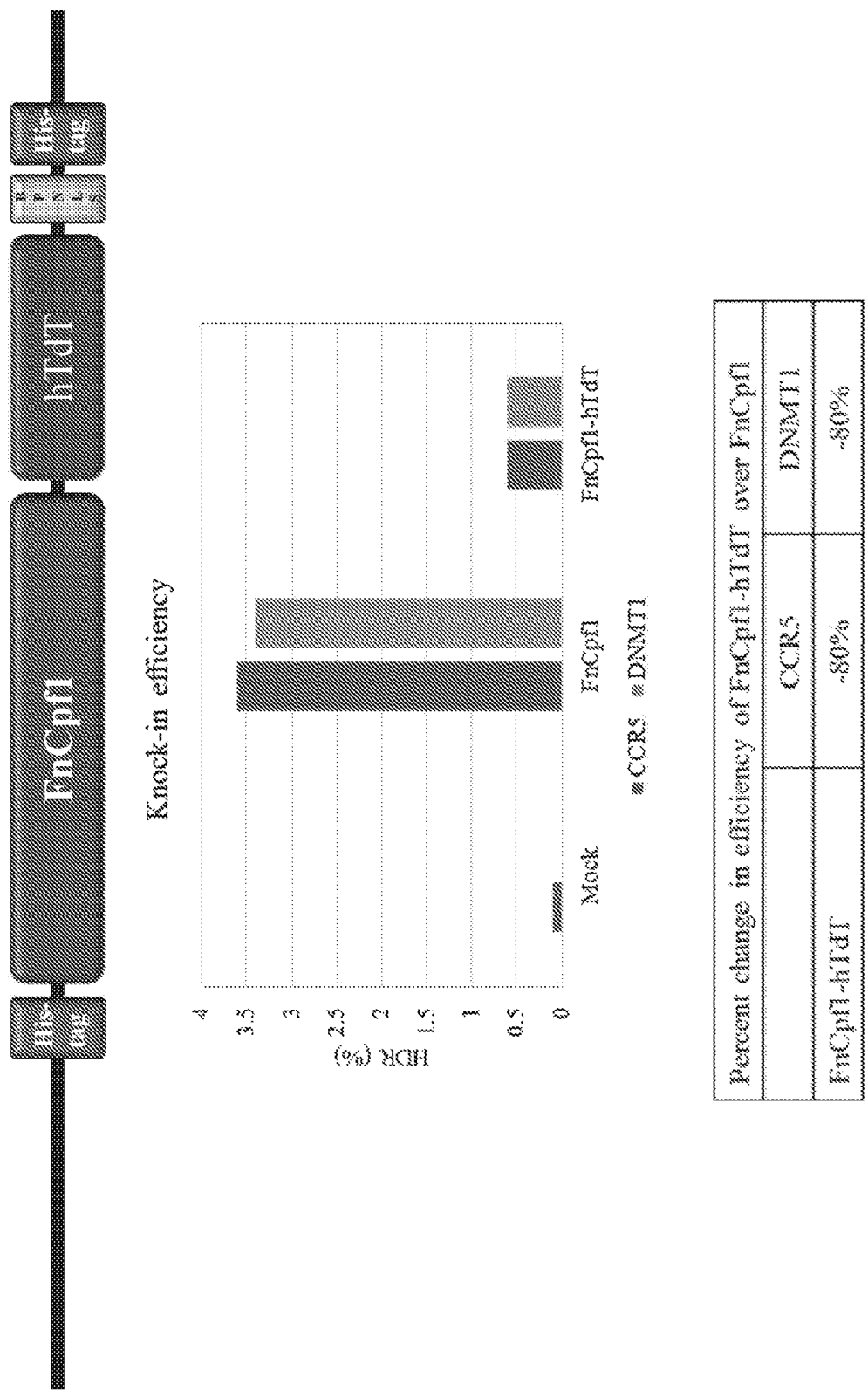

FIG. 107 illustrates a comparison of knock-in efficiencies between FnCpf1 and FnCpf1-hTdT. Shown at top is a schematic of FnCpf1-hTdT construct. Shown in the middle is a graph of editing efficiency at mock, FnCpf1, and FnCpf1-hTdT treatment. Shown at the bottom is a table providing the percent change in efficiency of FnCpf1-hTdT over FnCpf1.

Figure 108:
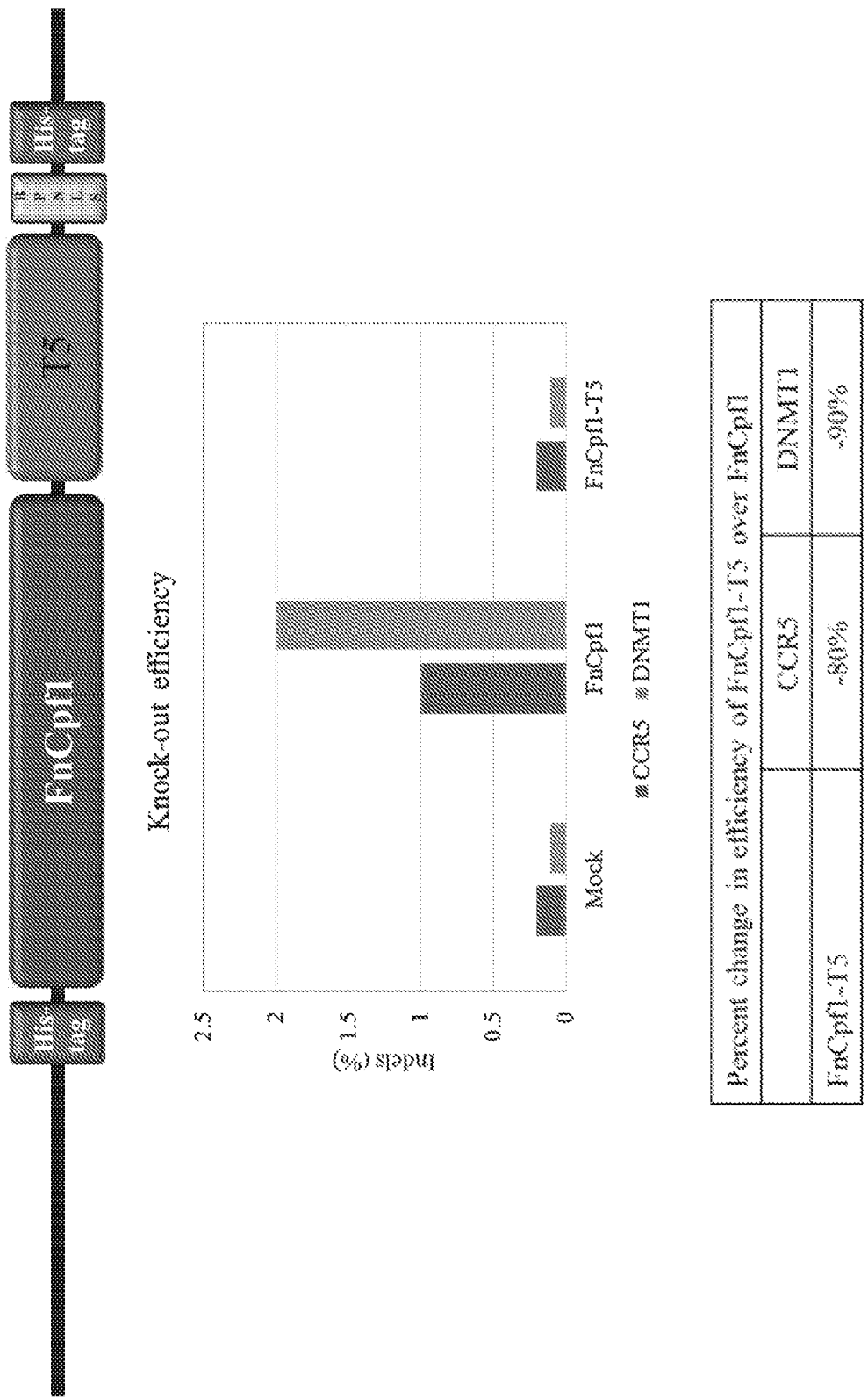

FIG. 108 illustrates a comparison of knock-out efficiencies between FnCpf1 and FnCpf1-T5. Shown at top is a schematic of FnCpf1-T5 construct. Shown in the middle is a graph of editing efficiency at mock, FnCpf1, and FnCpf1-T5 treatment. Shown at the bottom is a table providing the percent change in efficiency of FnCpf1-T5 over FnCpf1.

Figure 109:
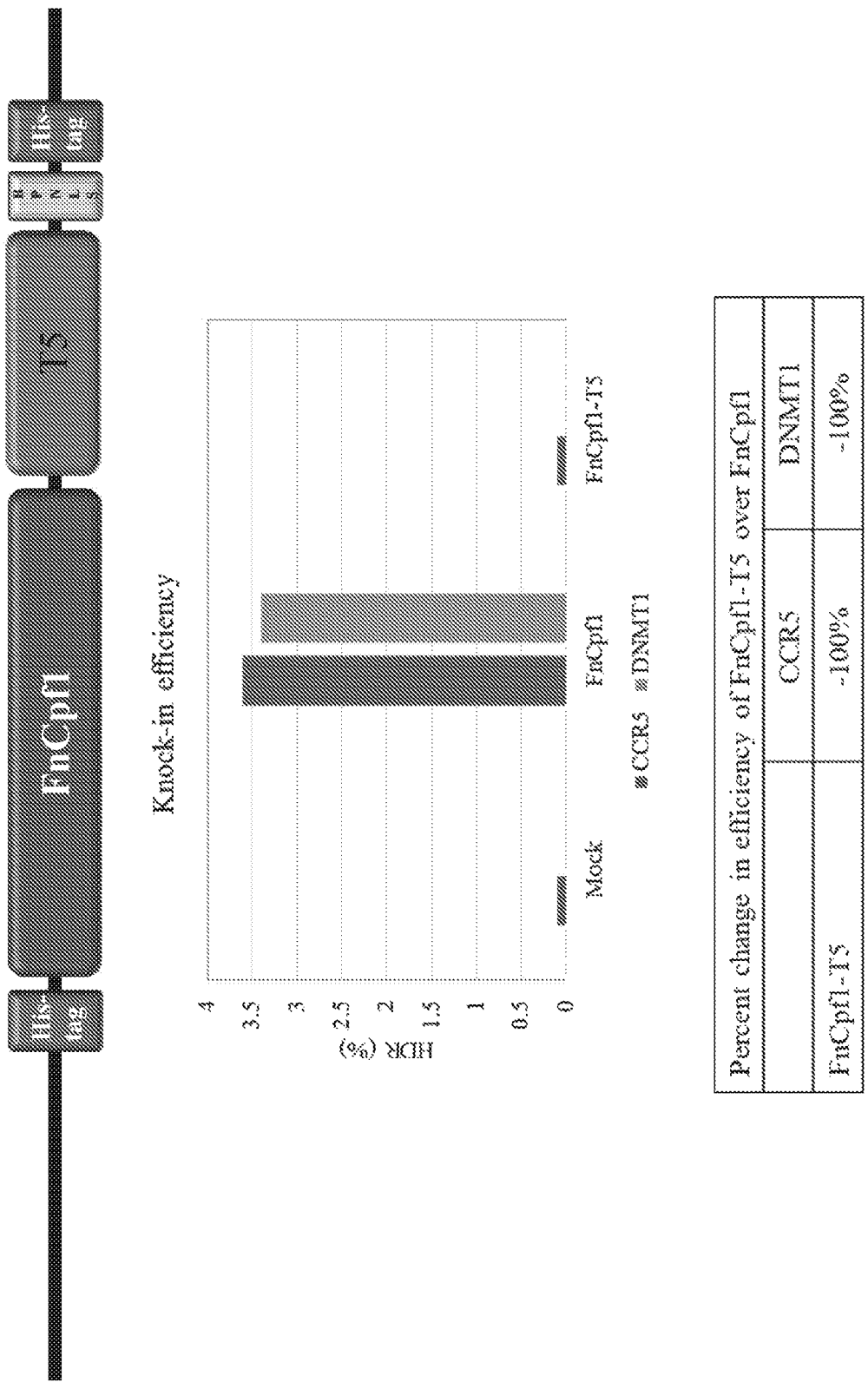

FIG. 109 illustrates a comparison of knock-in efficiencies between FnCpf1 and FnCpf1-T5. Shown at top is a schematic of FnCpf1-T5 construct. Shown in the middle is a graph of editing efficiency at mock, FnCpf1, and FnCpf1-T5 treatment. Shown at the bottom is a table providing the percent change in efficiency of FnCpf1-T5 over FnCpf1.

Figure 110:
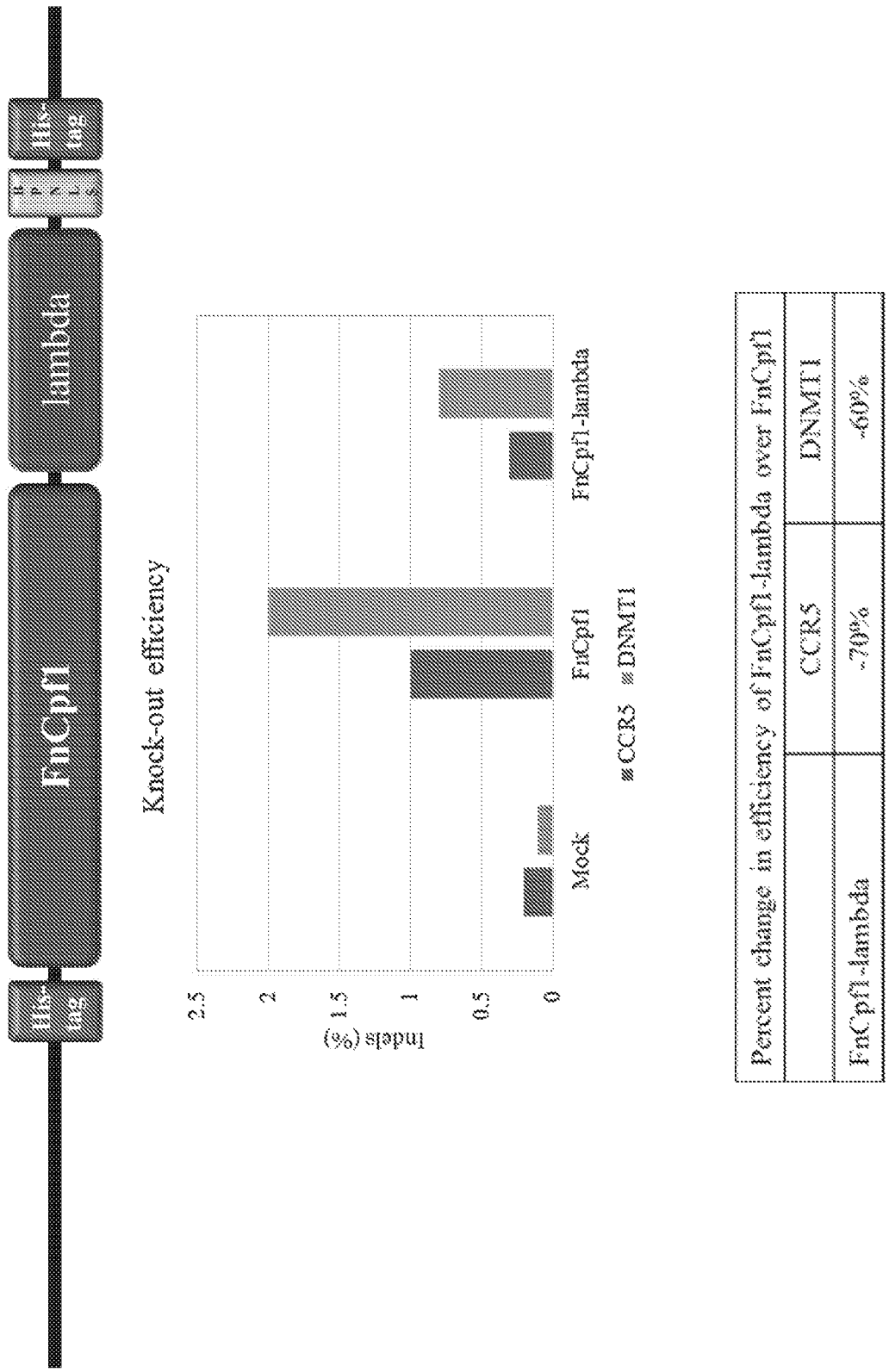

FIG. 110 illustrates a comparison of knock-out efficiencies between FnCpf1 and FnCpf1-lambda. Shown at top is a schematic of FnCpf1-lambda construct. Shown in the middle is a graph of editing efficiency at mock, FnCpf1, and FnCpf1-lambda treatment. Shown at the bottom is a table providing the percent change in efficiency of FnCpf1-lambda over FnCpf1.

Figure 111:
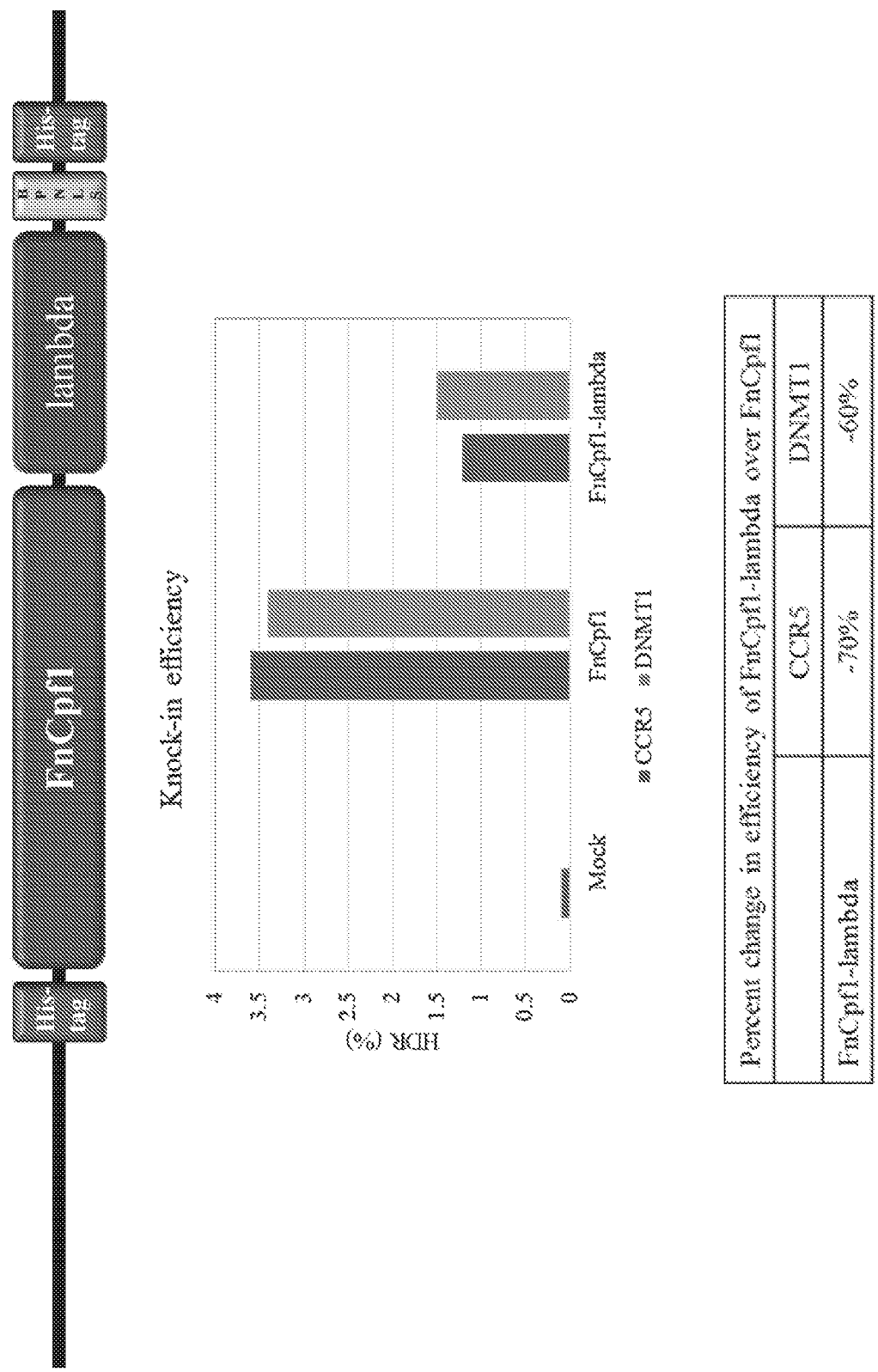

FIG. 111 illustrates a comparison of knock-in efficiencies between FnCpf1 and FnCpf1-lambda. Shown at top is a schematic of FnCpf1-lambda construct. Shown in the middle is a graph of editing efficiency at mock, FnCpf1, and FnCpf1-lambda treatment. Shown at the bottom is a table providing the percent change in efficiency of FnCpf1-lambda over FnCpf1.

Figure 112:
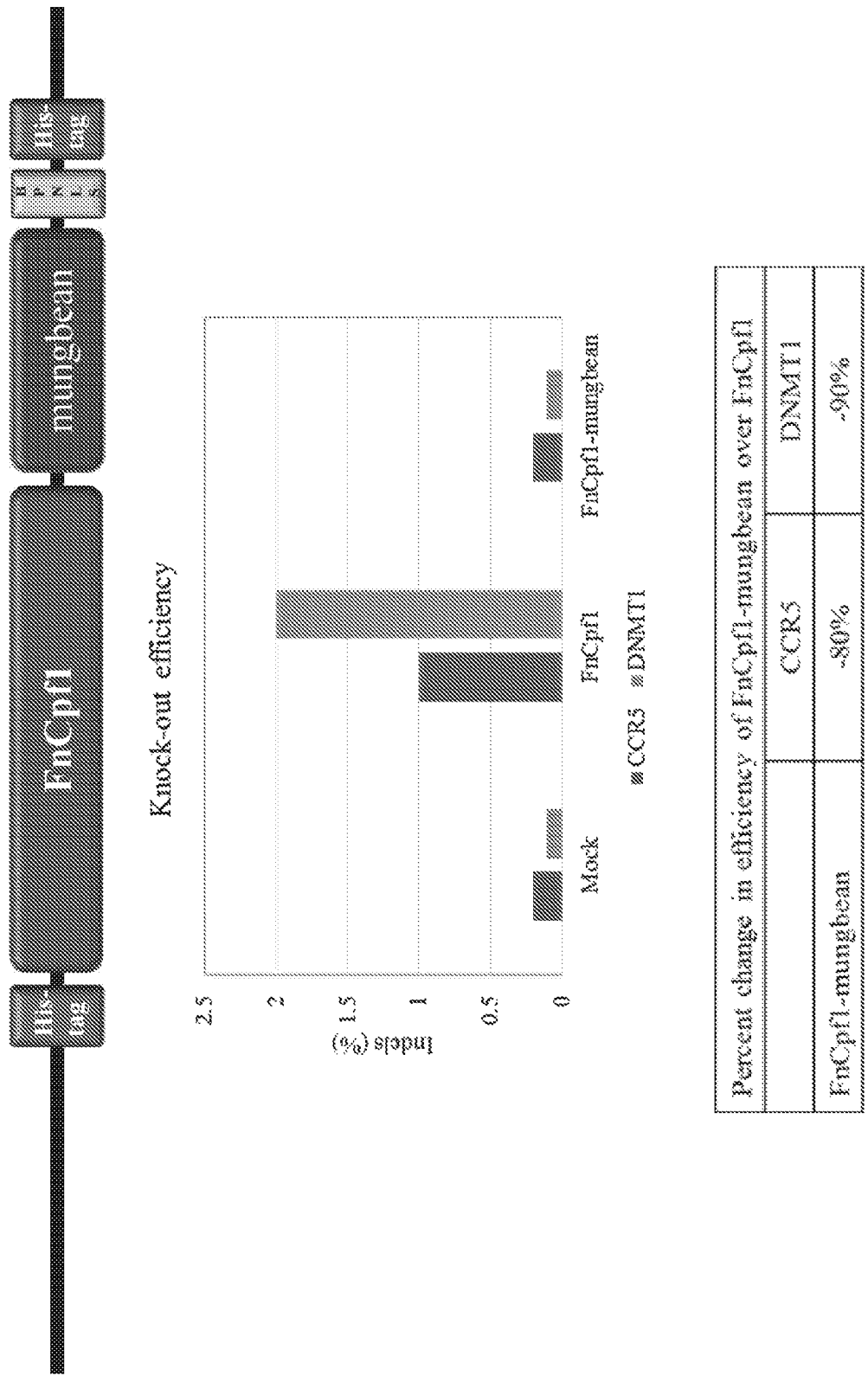

FIG. 112 illustrates a comparison of knock-out efficiencies between FnCpf1 and FnCpf1-mungbean. Shown at top is a schematic of FnCpf1-mungbean construct. Shown in the middle is a graph of editing efficiency at mock, FnCpf1, and FnCpf1-mungbean treatment. Shown at the bottom is a table providing the percent change in efficiency of FnCpf1-mungbean over FnCpf1.

Figure 113:
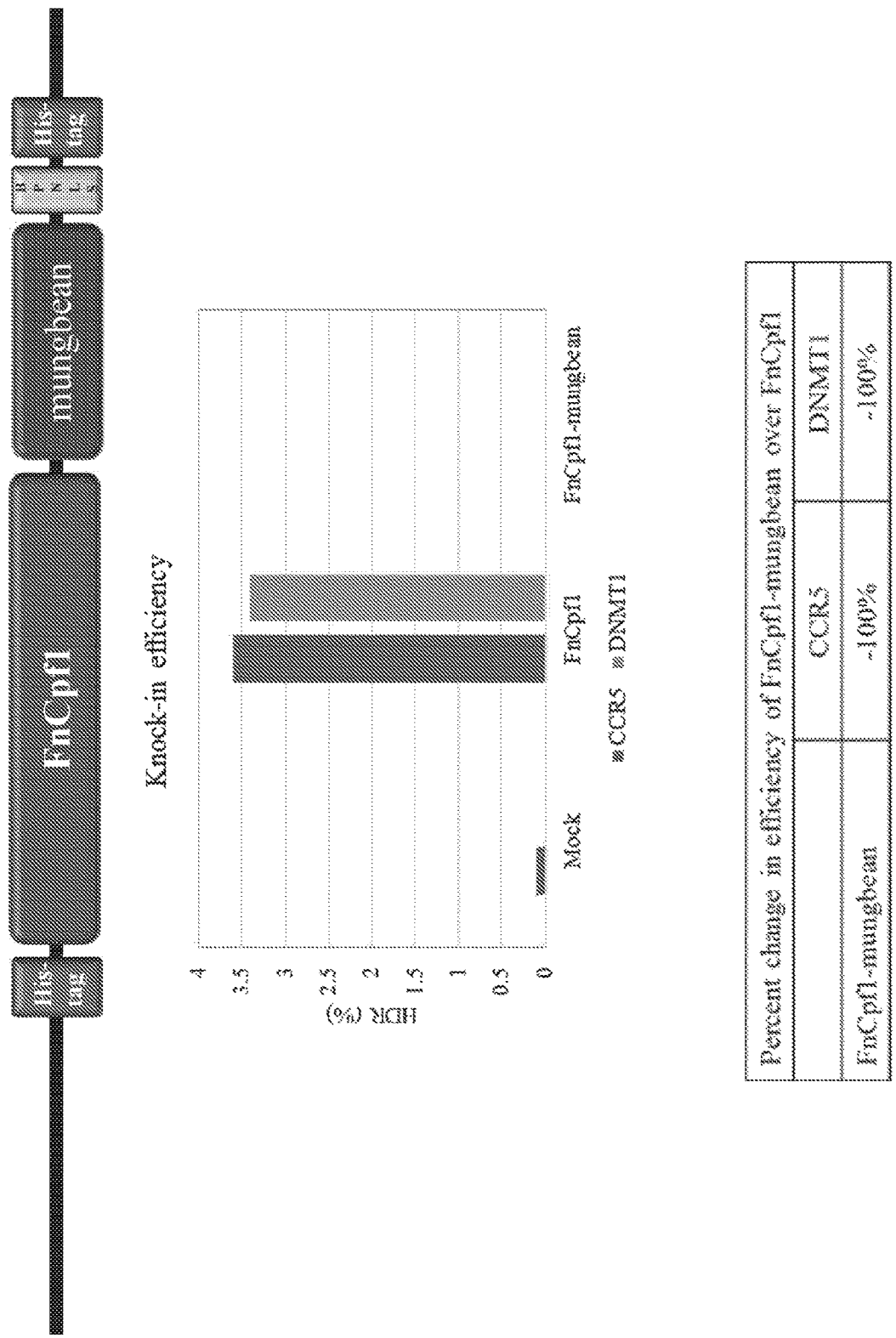

FIG. 113 illustrates a comparison of knock-in efficiencies between FnCpf1 and FnCpf1-mungbean. Shown at top is a schematic of FnCpf1-mungbean construct. Shown in the middle is a graph of editing efficiency at mock, FnCpf1, and FnCpf1-mungbean treatment. Shown at the bottom is a table providing the percent change in efficiency of FnCpf1-mungbean over FnCpf1.

Figure 114:
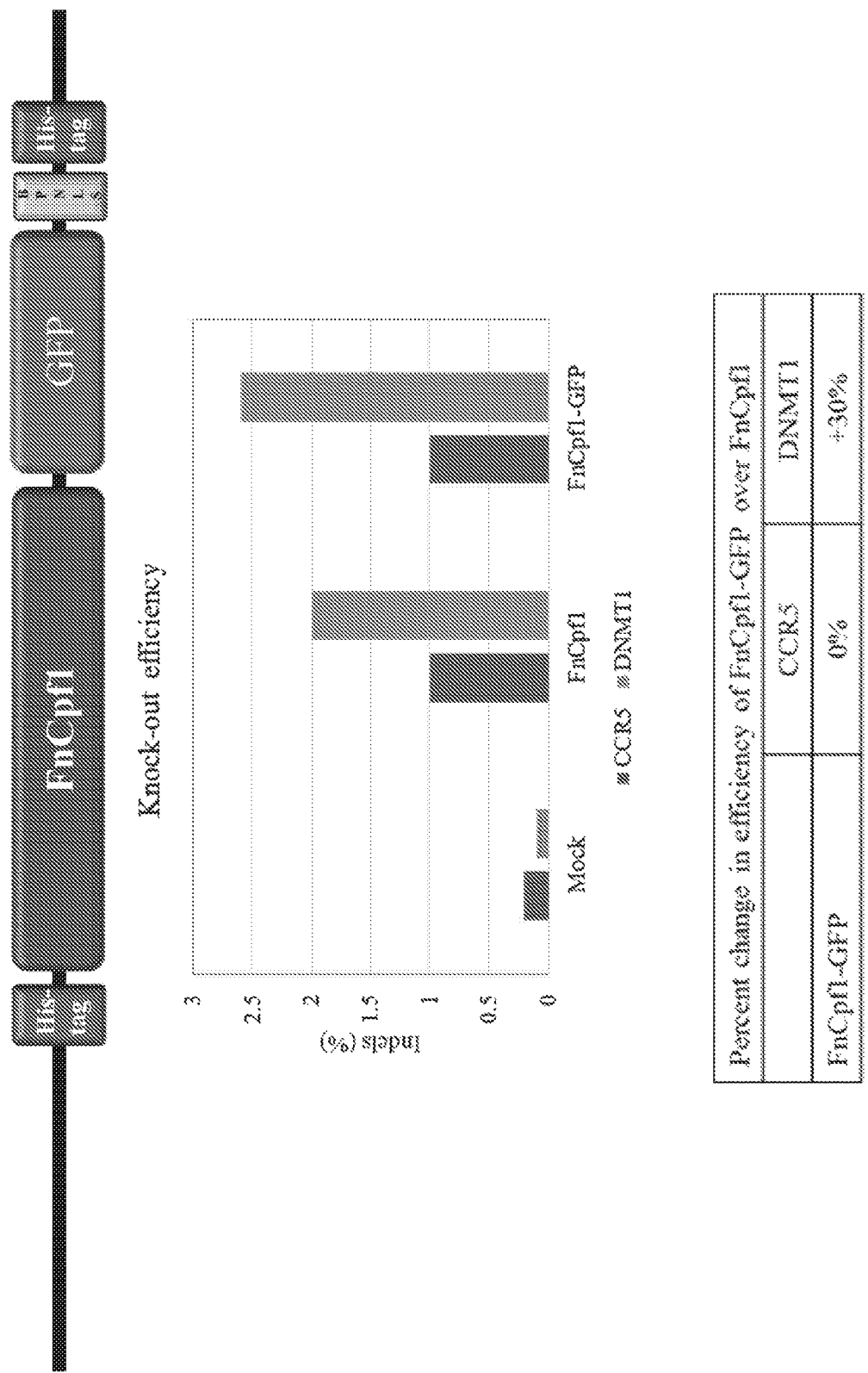

FIG. 114 illustrates a comparison of knock-out efficiencies between FnCpf1 and FnCpf1-GFP. Shown at top is a schematic of FnCpf1-GFP construct. Shown in the middle is a graph of editing efficiency at mock, FnCpf1, and FnCpf1-GFP treatment. Shown at the bottom is a table providing the percent change in efficiency of FnCpf1-GFP over FnCpf1.

Figure 115:
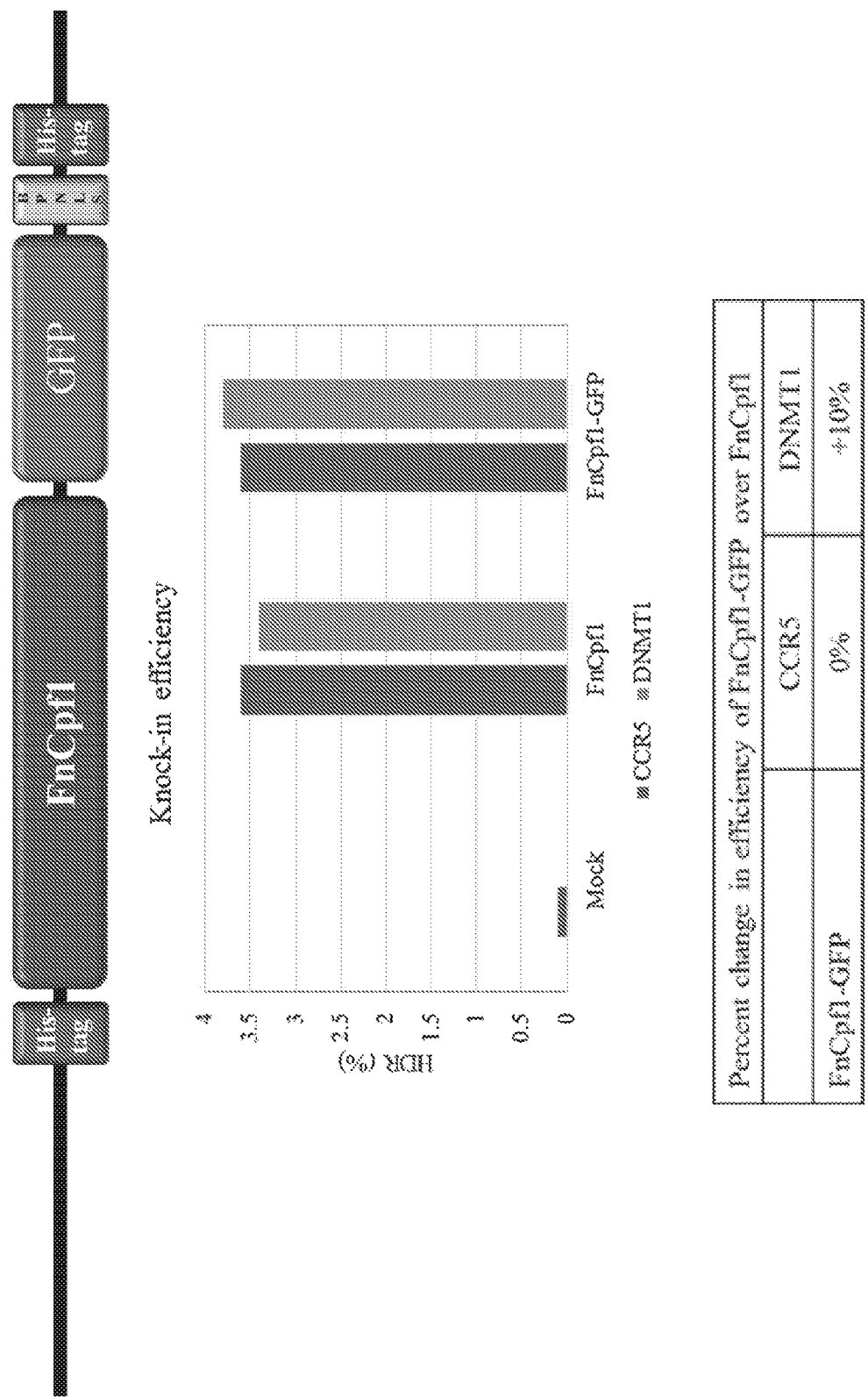

FIG. 115 illustrates a comparison of knock-in efficiencies between FnCpf1 and FnCpf1-GFP. Shown at top is a schematic of FnCpf1-GFP construct. Shown in the middle is a graph of editing efficiency at mock, FnCpf1, and FnCpf1-GFP treatment. Shown at the bottom is a table providing the percent change in efficiency of FnCpf1-GFP over FnCpf1.

Figure 116:
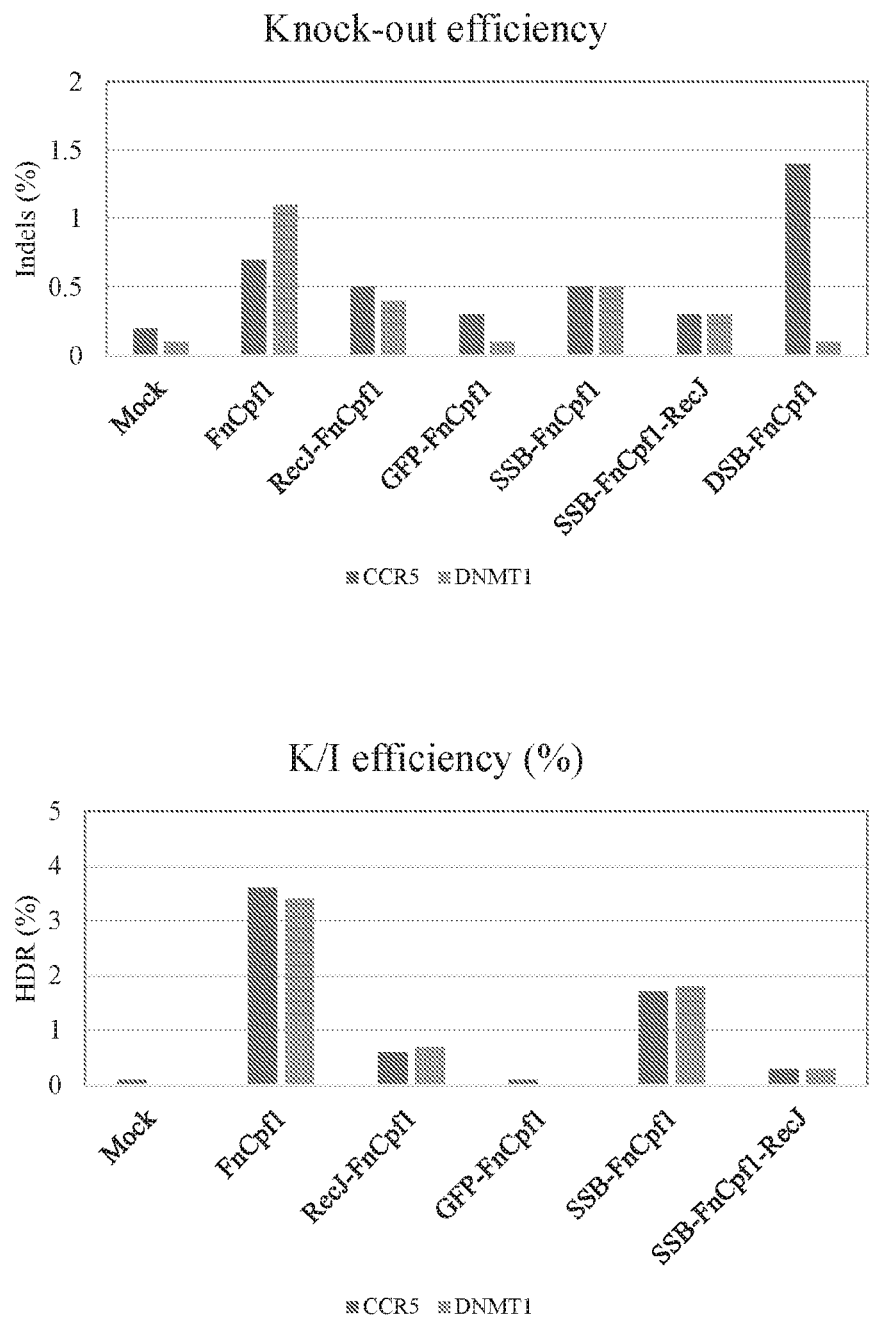

FIG. 116 illustrates editing efficiency comparison between FnCpf1 and FnCpf1 fusion proteins at N-terminus or both termini. FnCpf1 and FnCpf1 fusion proteins at N-terminus or both termini [exonucleases such as RecJ and RecE, GFP, single stranded DNA binding protein (SSB), and double stranded DNA binding protein (DSB)] show different genome editing efficiency. Shown at the left is a bar graph of knock-out efficiency as measured by percent indels for each group. Shown at the right is a bar graph of knock-in efficiency as measured by percent homology directed repair (HDR) for each group.

Figure 117:
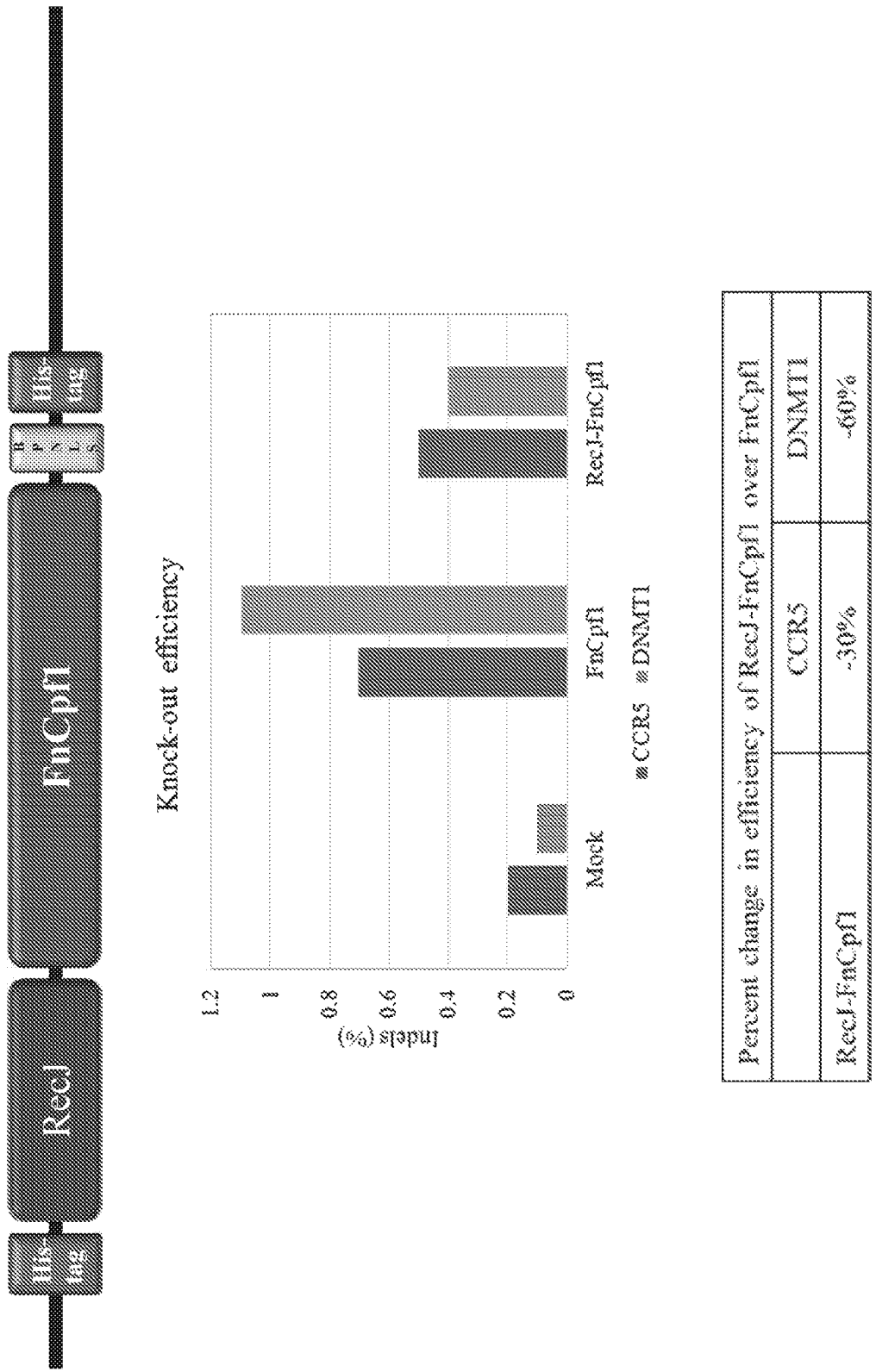

FIG. 117 illustrates a comparison of knock-out efficiencies between FnCpf1 and RecJ-FnCpf1. Shown at top is a schematic of RecJ-FnCpf1 construct. Shown in the middle is a graph of editing efficiency at mock, FnCpf1, and RecJ-FnCpf1 treatment. Shown at the bottom is a table providing the percent change in efficiency of RecJ-FnCpf1 over FnCpf1.

Figure 118:
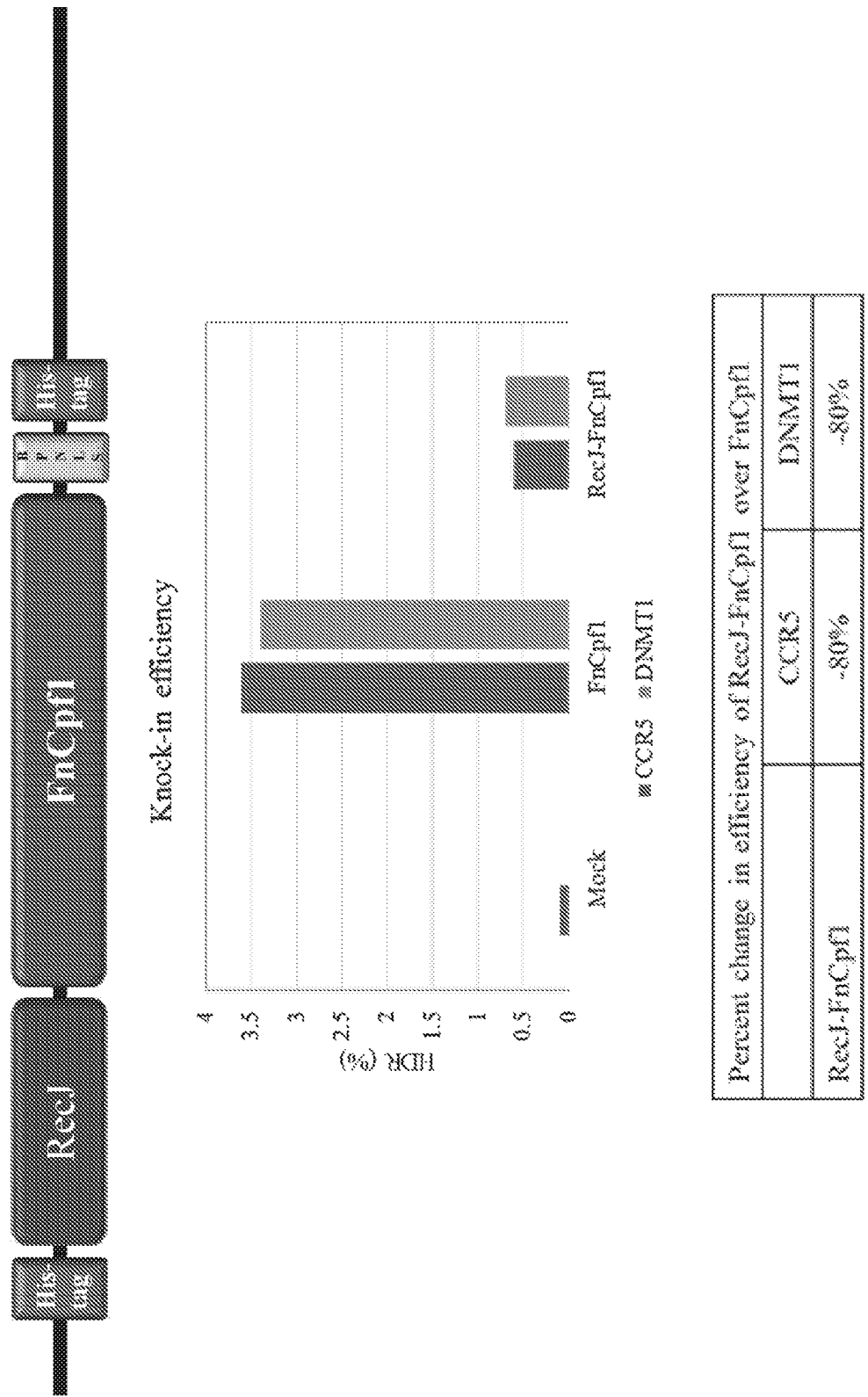

FIG. 118 illustrates a comparison of knock-in efficiencies between FnCpf1 and RecJ-FnCpf1. Shown at top is a schematic of RecJ-FnCpf1 construct. Shown in the middle is a graph of editing efficiency at mock, FnCpf1, and RecJ-FnCpf1 treatment. Shown at the bottom is a table providing the percent change in efficiency of RecJ-FnCpf1 over FnCpf1.

Figure 119:
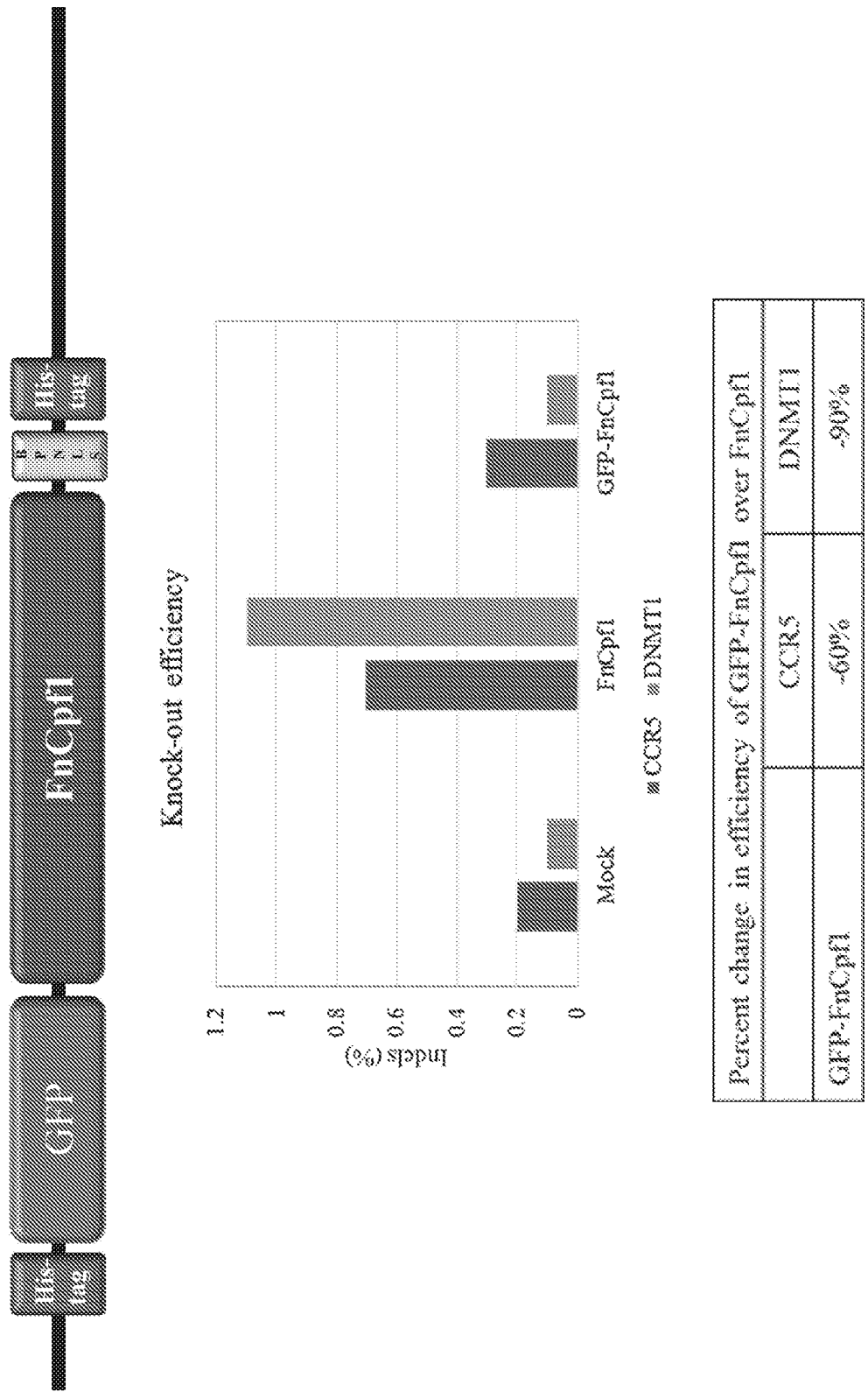

FIG. 119 illustrates a comparison of knock-out efficiencies between FnCpf1 and GFP-FnCpf1. Shown at top is a schematic of GFP-FnCpf1 construct. Shown in the middle is a graph of editing efficiency at mock, FnCpf1, and GFP-FnCpf1 treatment. Shown at the bottom is a table providing the percent change in efficiency of GFP-FnCpf1 over FnCpf1.

Figure 120:
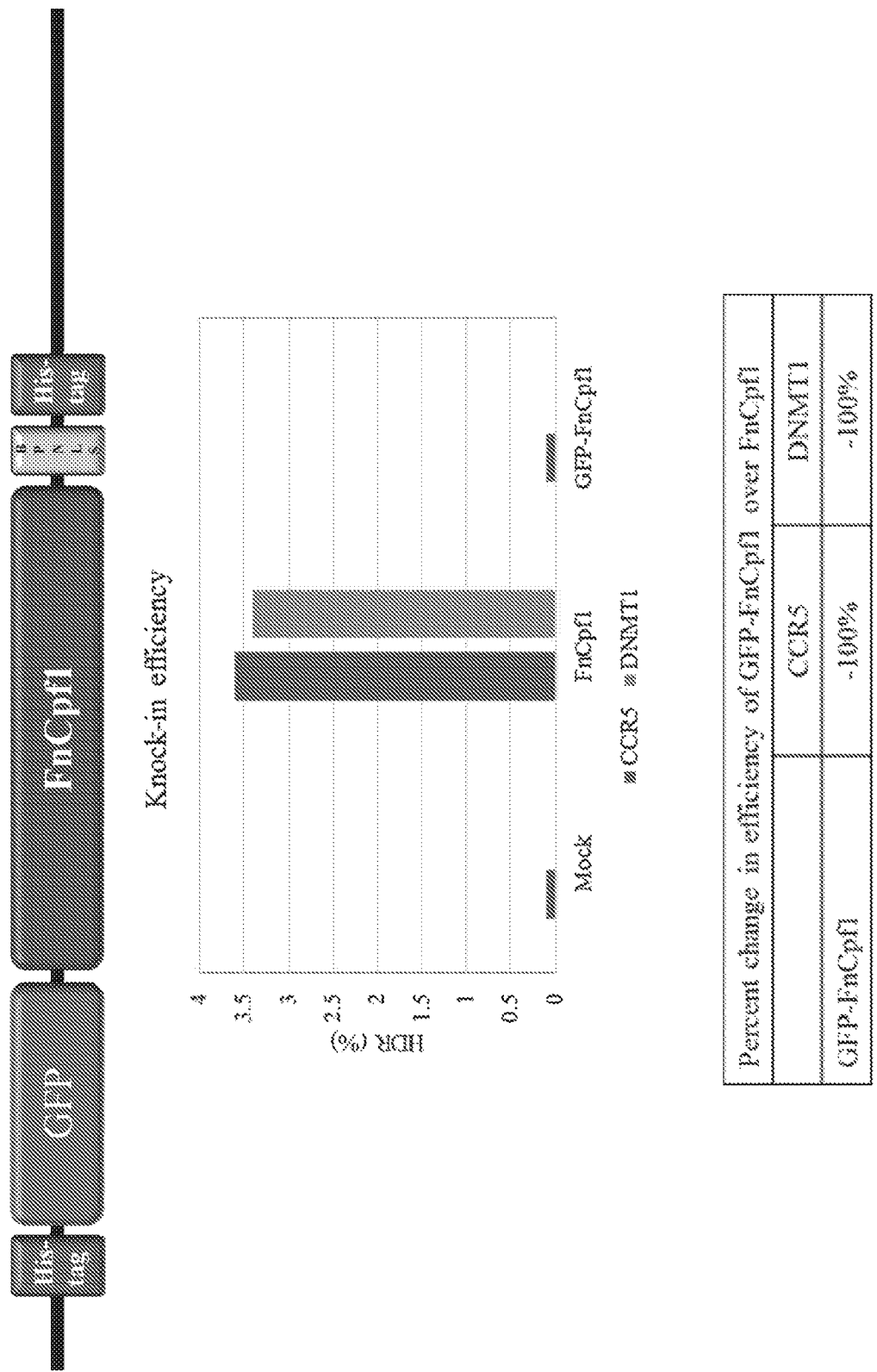

FIG. 120 illustrates a comparison of knock-in efficiencies between FnCpf1 and GFP-FnCpf1. Shown at top is a schematic of GFP-FnCpf1 construct. Shown in the middle is a graph of editing efficiency at mock, FnCpf1, and GFP- FnCpf1 treatment. Shown at the bottom is a table providing the percent change in efficiency of GFP-FnCpf1 over FnCpf1.

Figure 121:
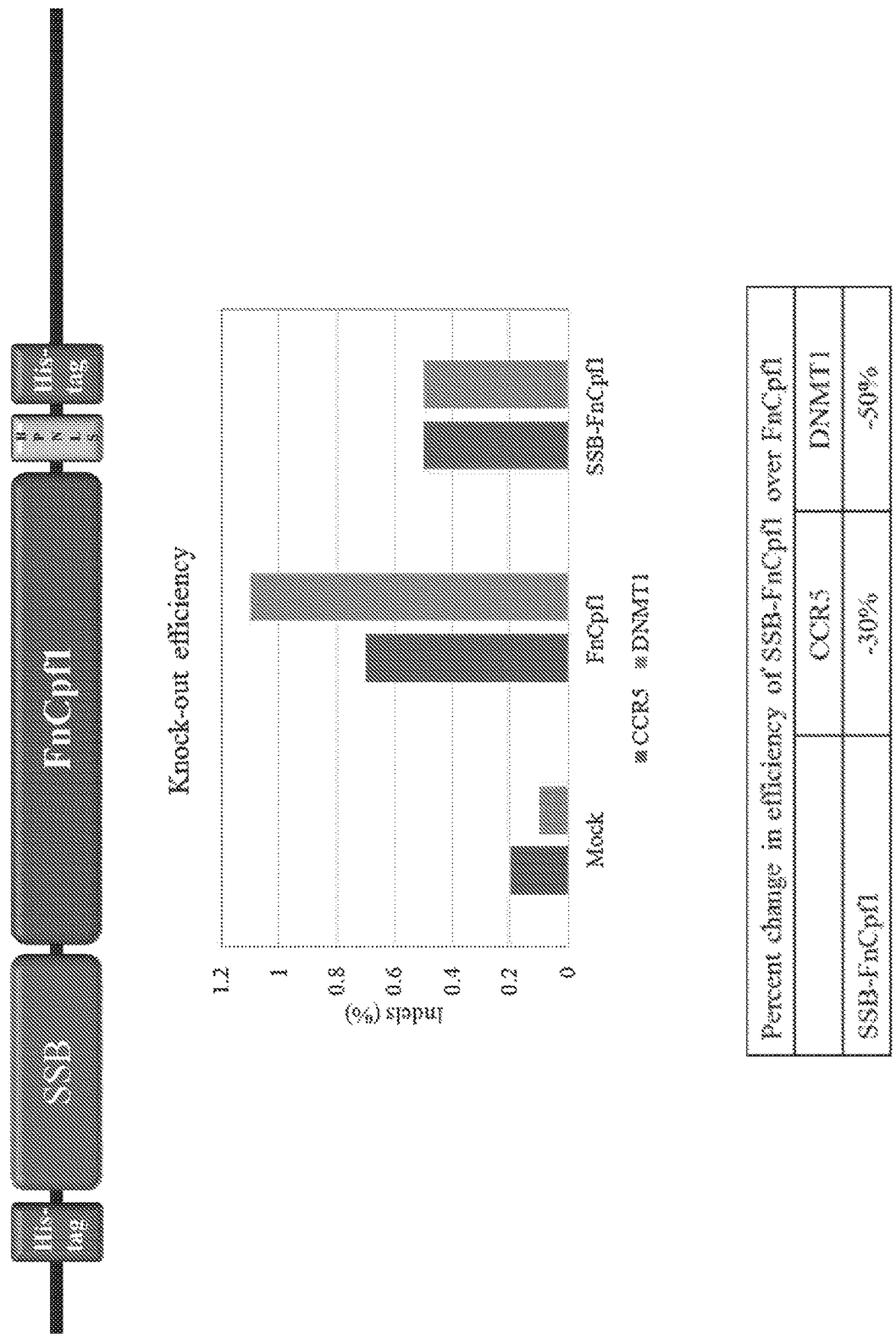

FIG. 121 illustrates a comparison of knock-out efficiencies between FnCpf1 and SSB-FnCpf1. Shown at top is a schematic of SSB-FnCpf1 construct. Shown in the middle is a graph of editing efficiency at mock, FnCpf1, and SSB-FnCpf1 treatment. Shown at the bottom is a table providing the percent change in efficiency of SSB-FnCpf1 over FnCpf1.

Figure 122:
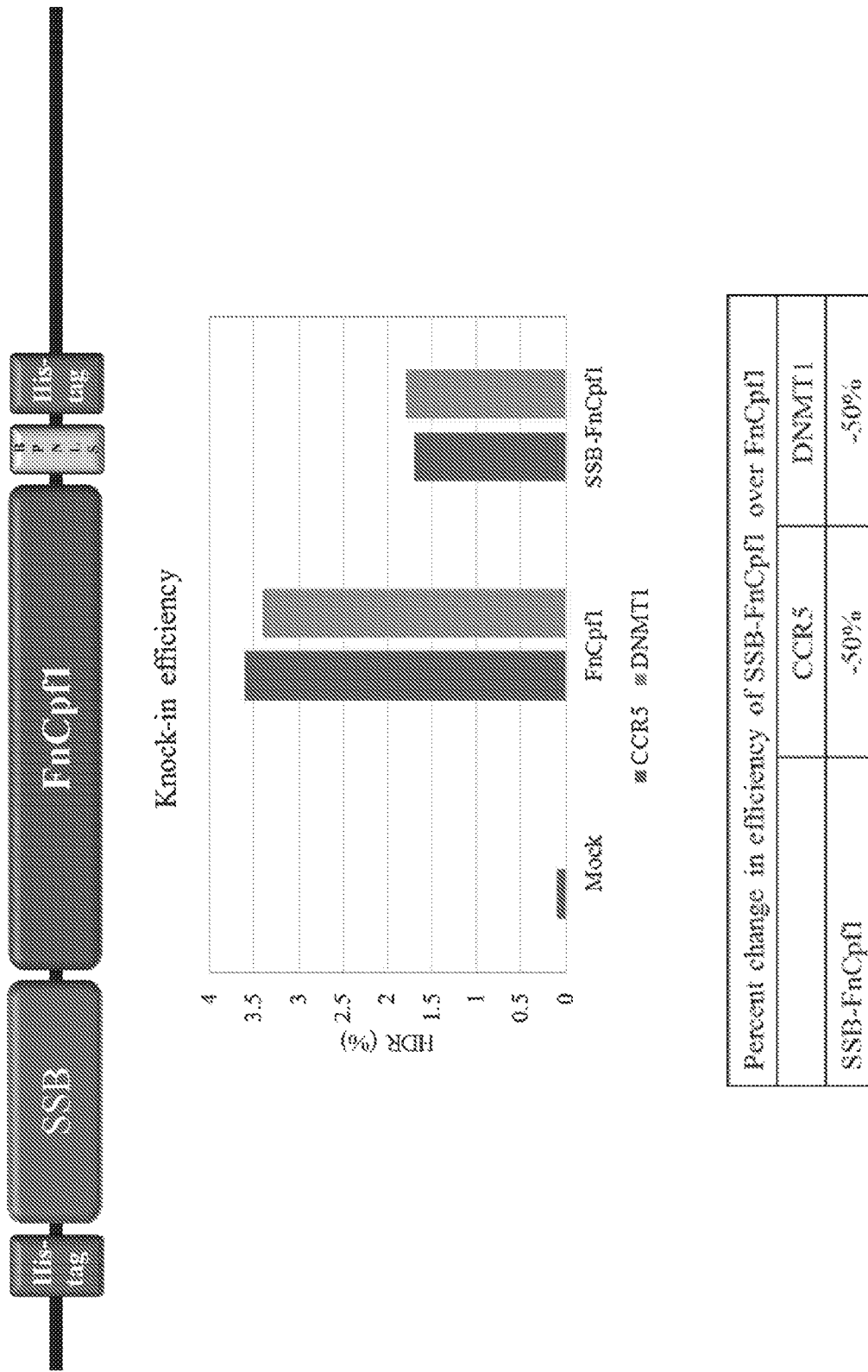

FIG. 122 illustrates a comparison of knock-in efficiencies between FnCpf1 and SSB-FnCpf1. Shown at top is a schematic of SSB-FnCpf1 construct. Shown in the middle is a graph of editing efficiency at mock, FnCpf1, and SSB-FnCpf1 treatment. Shown at the bottom is a table providing the percent change in efficiency of SSB-FnCpf1 over FnCpf1.

Figure 123:
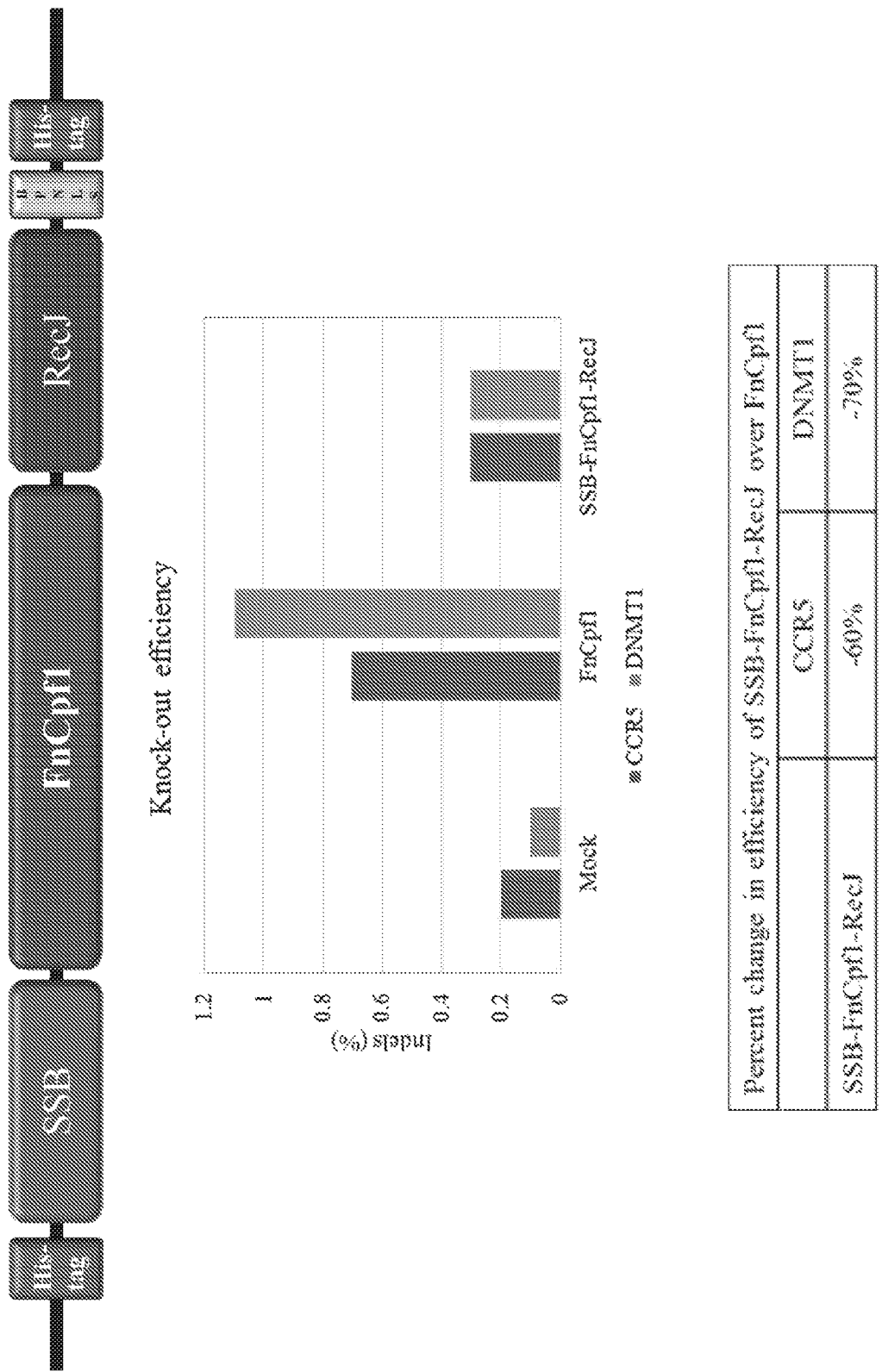

FIG. 123 illustrates a comparison of knock-out efficiencies between FnCpf1 and SSB-FnCpf1-RecJ. Shown at top is a schematic of SSB-FnCpf1-RecJ construct. Shown in the middle is a graph of editing efficiency at mock, FnCpf1, and SSB-FnCpf1-RecJ treatment. Shown at the bottom is a table providing the percent change in efficiency of SSB-FnCpf1-RecJ over FnCpf1.

Figure 124:
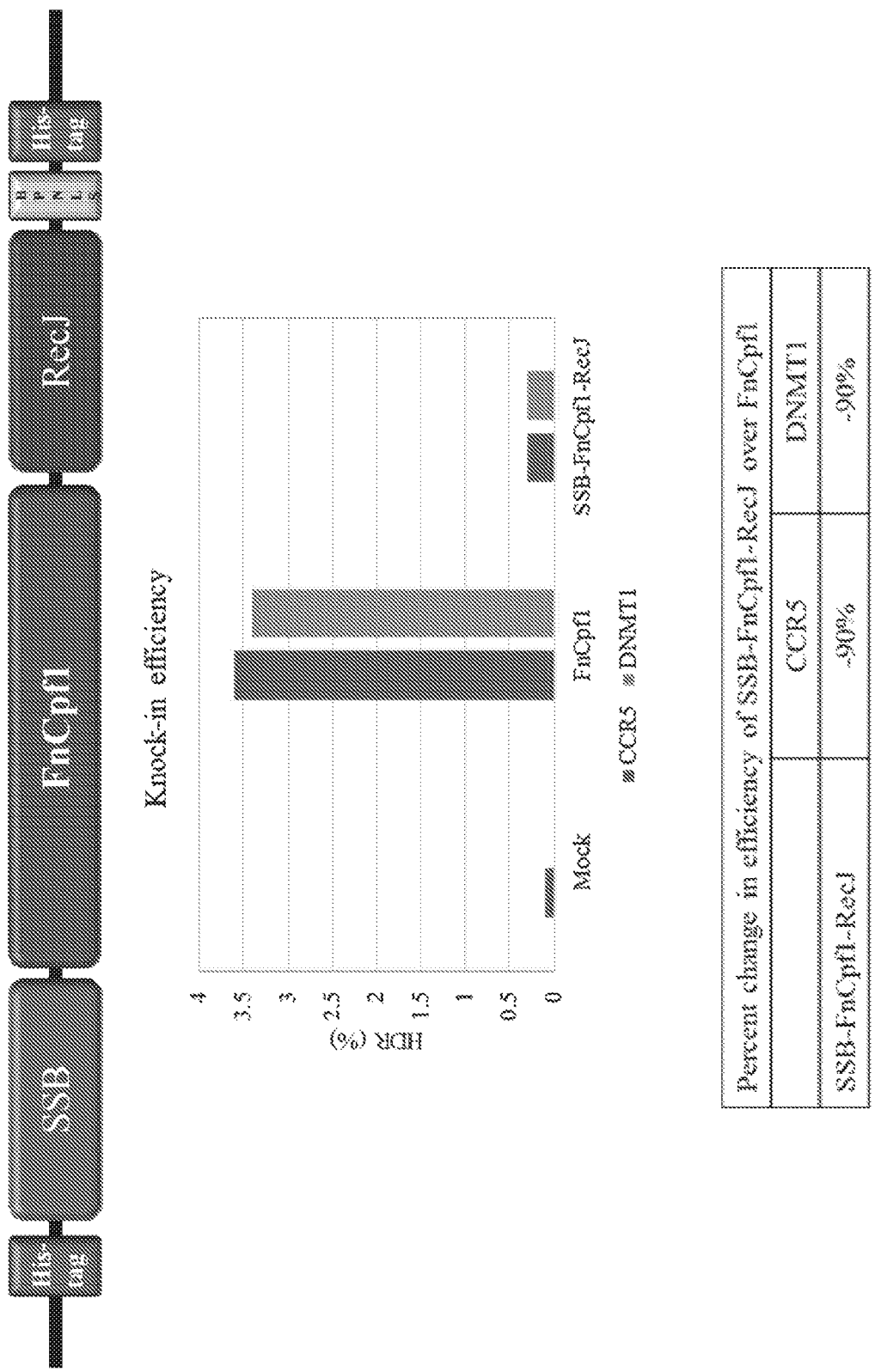

FIG. 124 illustrates a comparison of knock-in efficiencies between FnCpf1 and SSB-FnCpf1-RecJ. Shown at top is a schematic of SSB-FnCpf1-RecJ construct. Shown in the middle is a graph of editing efficiency at mock, FnCpf1, and SSB-FnCpf1-RecJ treatment. Shown at the bottom is a table providing the percent change in efficiency of SSB-FnCpf1-RecJ over FnCpf1.

FIG. 125 illustrates a comparison of knock-out efficiencies between FnCpf1 and DSB-FnCpf1. Shown at top is a schematic of DSB-FnCpf1 construct. Shown in the middle is a graph of editing efficiency at mock, FnCpf1, and DSB-FnCpf1 treatment. Shown at the bottom is a table providing the percent change in efficiency of DSB-FnCpf1 over FnCpf1.

Figure 126:
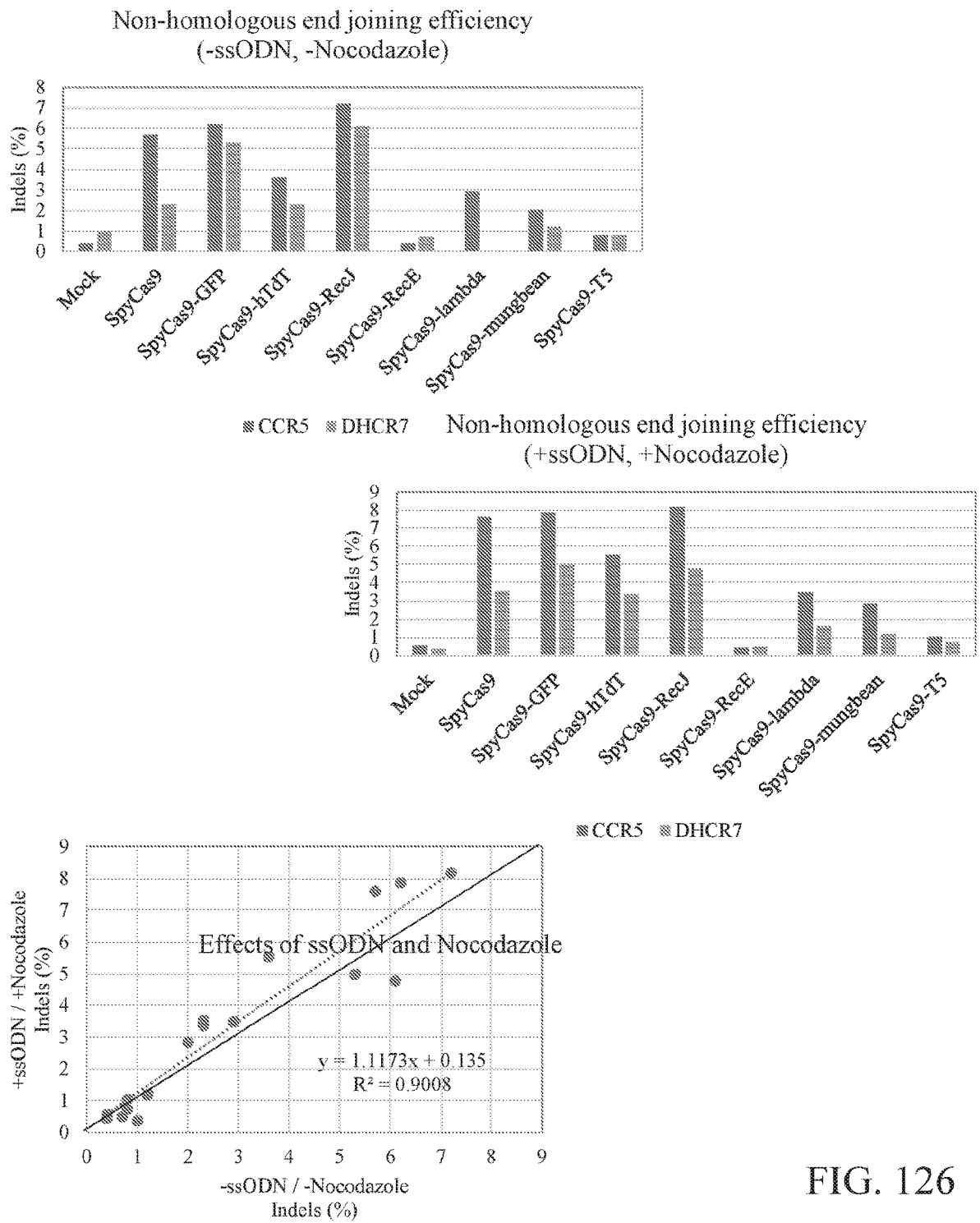

FIG. 126 illustrates the effects of ssODN and nocodazole on non-homologous end joining induced by SpyCas9 and SpyCas9 fusion proteins at C-terminus. Shown above and to the left is a bar graph showing non-homologous end joining efficiency comparison between SpyCas9 and SpyCas9 fusion proteins at C-terminus when ssODN and nocodazole are not treated. Shown above and to the right is a bar graph showing non-homologous end joining efficiency comparison between SpyCas9 and SpyCas9 fusion proteins at C-terminus when ssODN and nocodazole are treated. Shown below and to the left is graph illustrating a comparison of non-homologous end joining efficiency with and without ssODN and nocodazole treatment. Treatment of ssODN and nocodazole does not significantly affect the knock-out induced by SpyCas9 and SpyCas9 fusion proteins at C-terminus.

Figure 127:
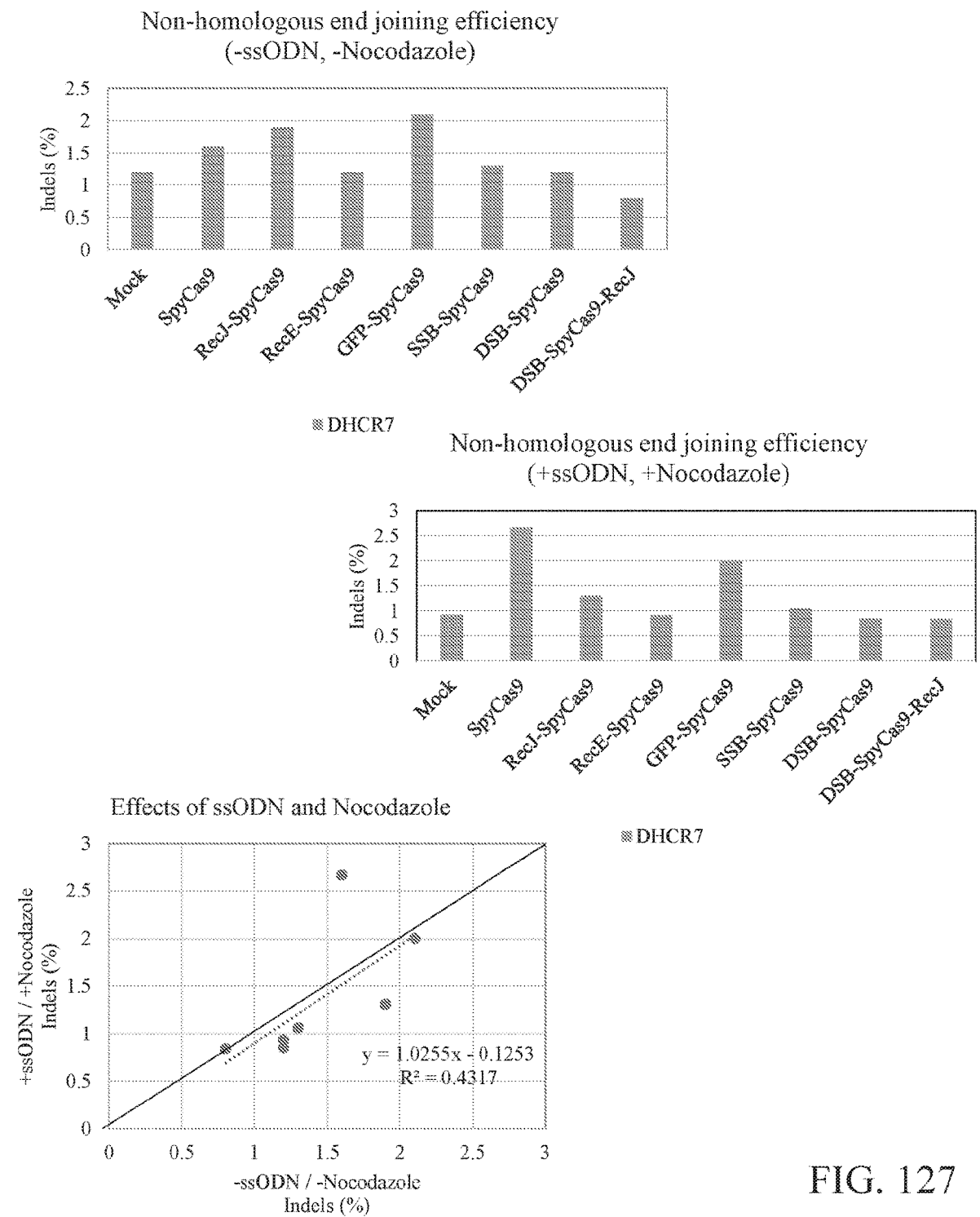

FIG. 127 illustrates the effects of ssODN and nocodazole on non-homologous end joining induced by SpyCas9 and SpyCas9 fusion proteins at N-terminus or both termini. Shown at the top and to the left is a bar graph illustrating non-homologous end joining efficiency comparison between SpyCas9 and SpyCas9 fusion proteins at N-terminus or both termini when ssODN and nocodazole are not treated. Shown at the top and to the right is a bar graph illustrating non-homologous end joining efficiency comparison between SpyCas9 and SpyCas9 fusion proteins at N-terminus or both termini when ssODN and nocodazole are treated. Shown below and to the left is a comparison of non-homologous end joining efficiency with and without ssODN and nocodazole treatment. Treatment of ssODN and nocodazole does not significantly affect the knock-out induced by SpyCas9 and SpyCas9 fusion proteins at N-terminus or both termini.

Figure 128:
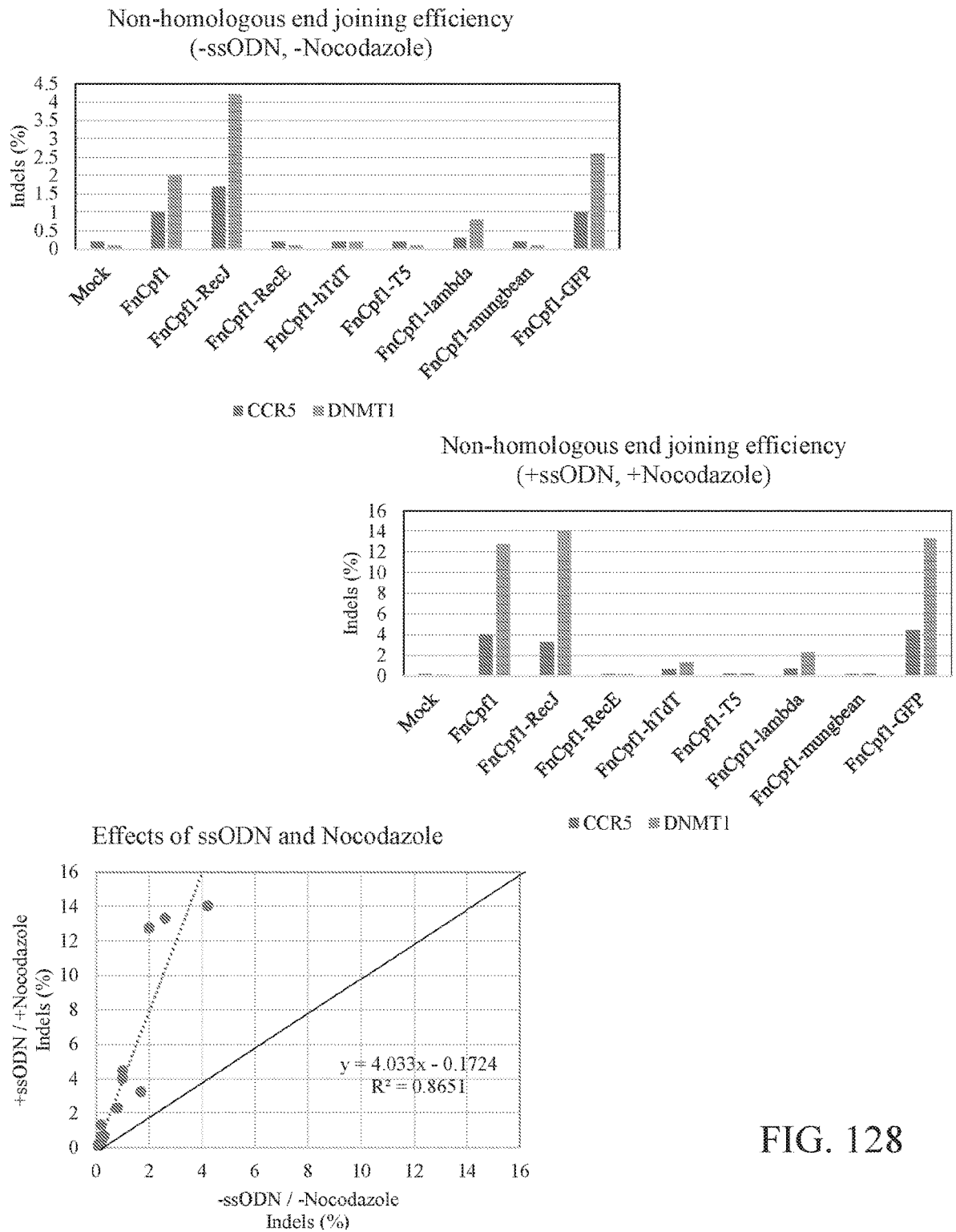

FIG. 128 illustrates effects of ssODN and nocodazole on non-homologous end joining induced by FnCpf1 and FnCpf1 fusion proteins at C-terminus. Shown above and to the left is a bar graph showing non-homologous end joining efficiency comparison between FnCpf1 and FnCpf1 fusion proteins at C-terminus when ssODN and nocodazole are not treated. Shown above and to the right is a bar graph showing non-homologous end joining efficiency comparison between FnCpf1 and FnCpf1 fusion proteins at C-terminus when ssODN and nocodazole are treated. Shown at bottom is a graph illustrating a comparison of non-homologous end joining efficiency with and without ssODN and nocodazole treatment. Treatment of ssODN and nocodazole increases the efficiency of knock-out induced by FnCpf1 and FnCpf1 fusion proteins at C-terminus.

Figure 129:
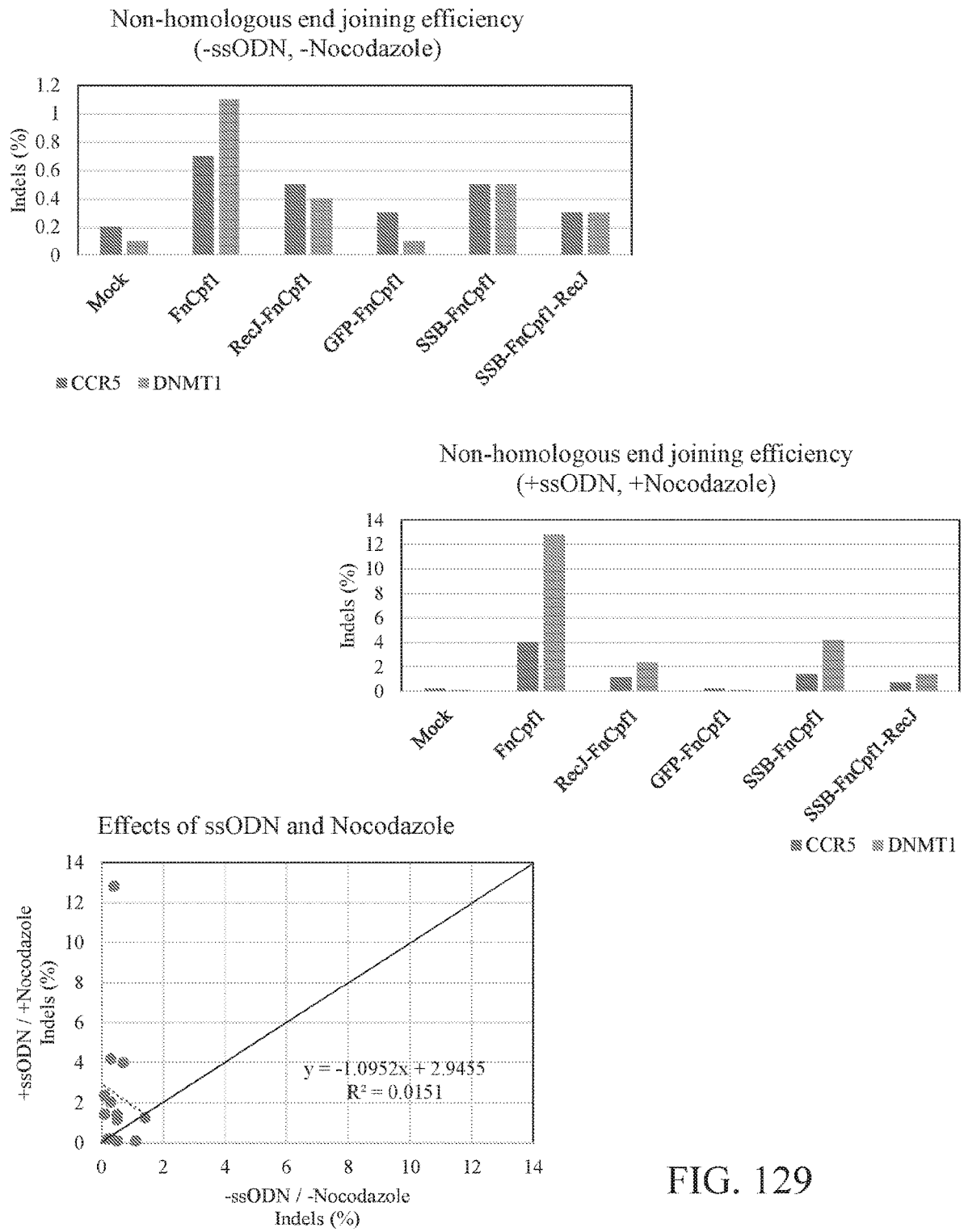

FIG. 129 illustrates effects of ssODN and nocodazole on non-homologous end joining induced by FnCpf1 and FnCpf1 fusion proteins at N-terminus or both termini. Shown above and to the left is a bar graph showing non-homologous end joining efficiency comparison between FnCpf1 and FnCpf1 fusion proteins at N-terminus or both termini when ssODN and nocodazole are not treated. Shown above and to the right is a bar graph showing non-homologous end joining efficiency comparison between FnCpf1 and FnCpf1 fusion proteins at N-terminus or both termini when ssODN and nocodazole are treated. Shown at bottom is a graph illustrating a comparison of non-homologous end joining efficiency with and without ssODN and nocodazole treatment. Treatment of ssODN and nocodazole does not significantly affect the knock-out induced by FnCpf1 and FnCpf1 fusion proteins at N-terminus or both termini.

FIG. 130 illustrates a schematic depicting cell-based validation for each experiment. The on-target sequence was shown at the top of the alignment, mismatched nucleotides are highlighted. GFLAS01 was a negative control; GFLAS2, GFLAS3, and GFLAS4 for CCR5 sgRNA treatment; GFLAS05, GFLAS06, and GFLAS07 for DHCR7 treatment—GFLAS02 and GFLAS05 for SpyCas9 at 48 h; GFLAS03, GFLAS06 for Cas9-RecJ at 24 h; GFLAS04, and GFLAS07 for Cas9-RecJ at 48 h. Star symbol (*) stand for below a significant value (<0.05). Figure discloses SEQ ID NOS 212-323, 288 and 324-326, respectively, in order of columns.

FIG. 131 illustrates gene editing efficiency in *N. benthamiana* protoplasts. Each Cas9 variant and the same guide RNA against the same loci of *N. benthamiana* FucT13_1 were transfected to protoplasts of 4-week-old leaves of *N. benthamiana*. The protoplasts using PEG-mediated transfection method. Cells were harvested at 24 h, 48, and 72 h after transfection, and then genomic DNA was extraction. In order to improve discriminability of cut DNA band, alternative PCR primer pairs were used for clearer single whose sizes, which were subjected to in vitro cleavage assay with SpyCas9/sgRNA. sgRNA sequence is CAAGGGCTTCTAAAGCTTGCAAA (SEQ ID NO: 60). Primer pairs for PCR are F1, GCAGAATTAGTTGAGCGC-CACCAGATA (SEQ ID NO: 61); R1, GTGCAAAACAACAGCAAAAGAAGA-TAACAATAACAATAAC (SEQ ID NO: 62). Figure discloses SEQ ID NOS 327, 327-328, 328-329 and 329, respectively, in order of columns.

Figure 132:
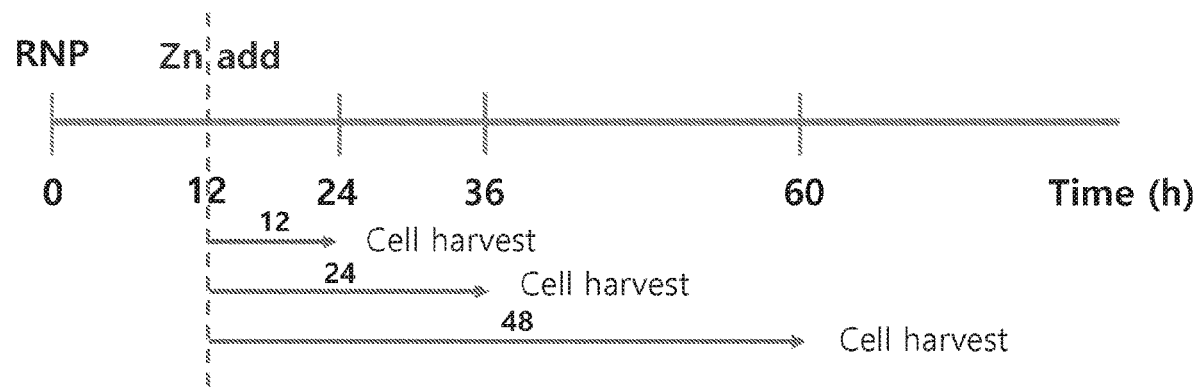

FIG. 132 shows a for zinc sulfate treatment. HEK293 cells were harvested at 12 h, 24 h, and 48 h after zinc sulfate treatment. In terms of RNP treatment, HEK293 cells were harvested at 24 h, 36 h, and 60 h.

Figure 133:
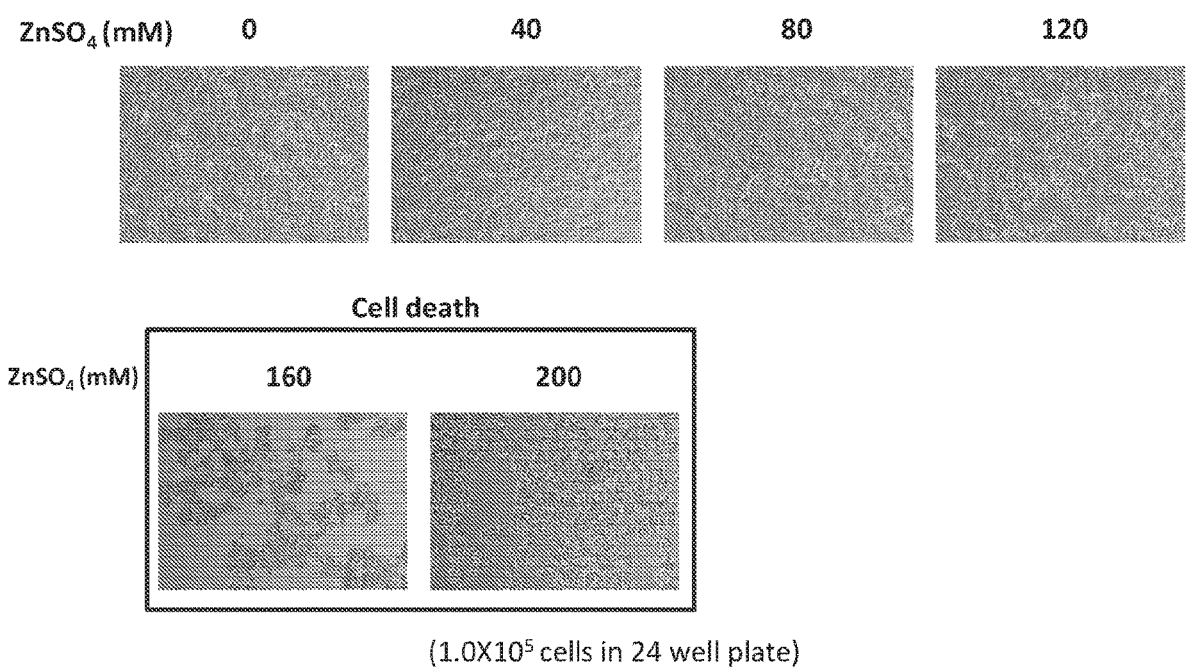

FIG. 133 shows HEK293 cell images along with gradual zinc sulfate concentration. The concentrations of 0 to 120 mM 160 mM of zinc sulfate allowed HEK293 cell to survive, whereas 160 mM and 200 mM zinc sulfate treatments did not allow HEK293 live well without toxicity effect.

Figure 134:
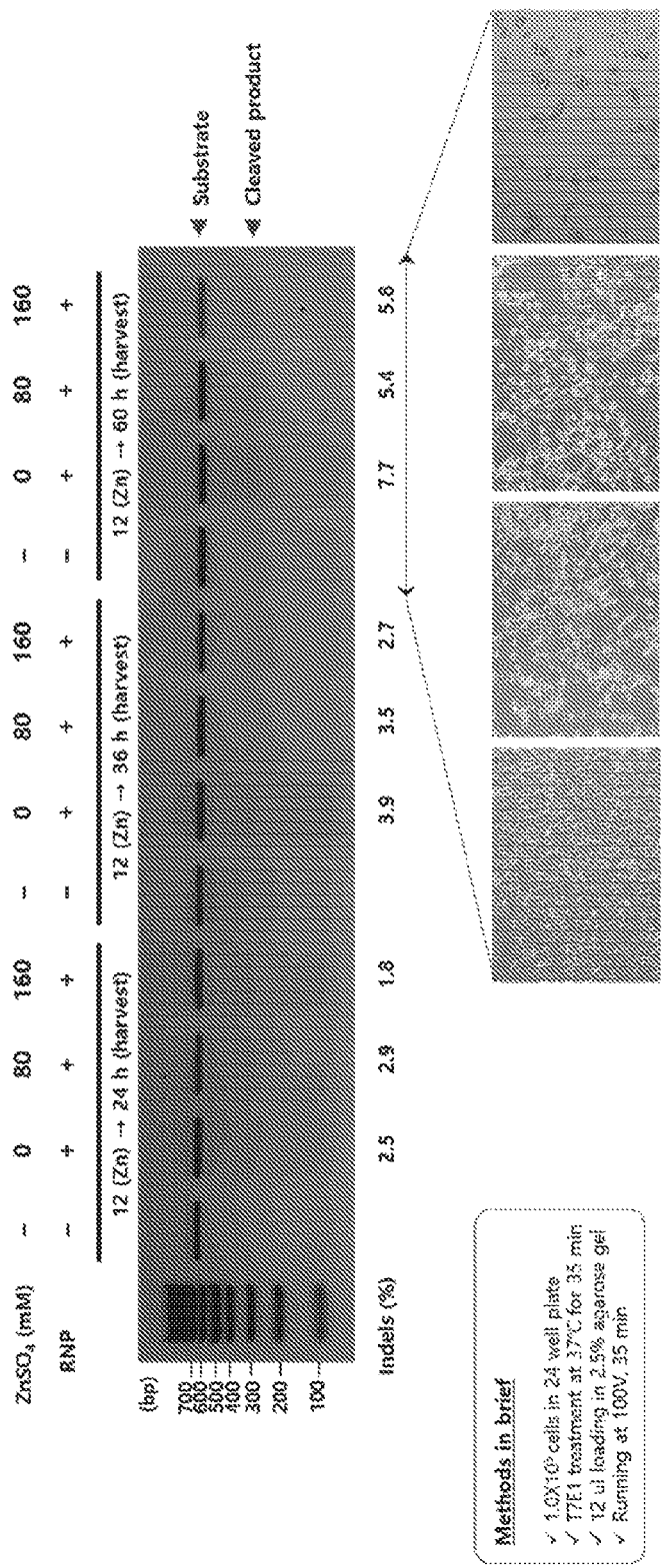

FIG. 134 shows in vitro cleavage assay after zinc sulfate treatment. The concentrations of 80 mM 160 mM of zinc sulfate were treated in HEK293 with Cas9 variants. HEK293 cells were harvested at 12 h, 24 h, and 48 h after zinc sulfate treatment. In terms of RNP treatment, HEK293 cells were harvested at 24 h, 36 h, and 60 h. The genome editing efficacy was reduced after zinc sulfate treatment.

Figure 135:
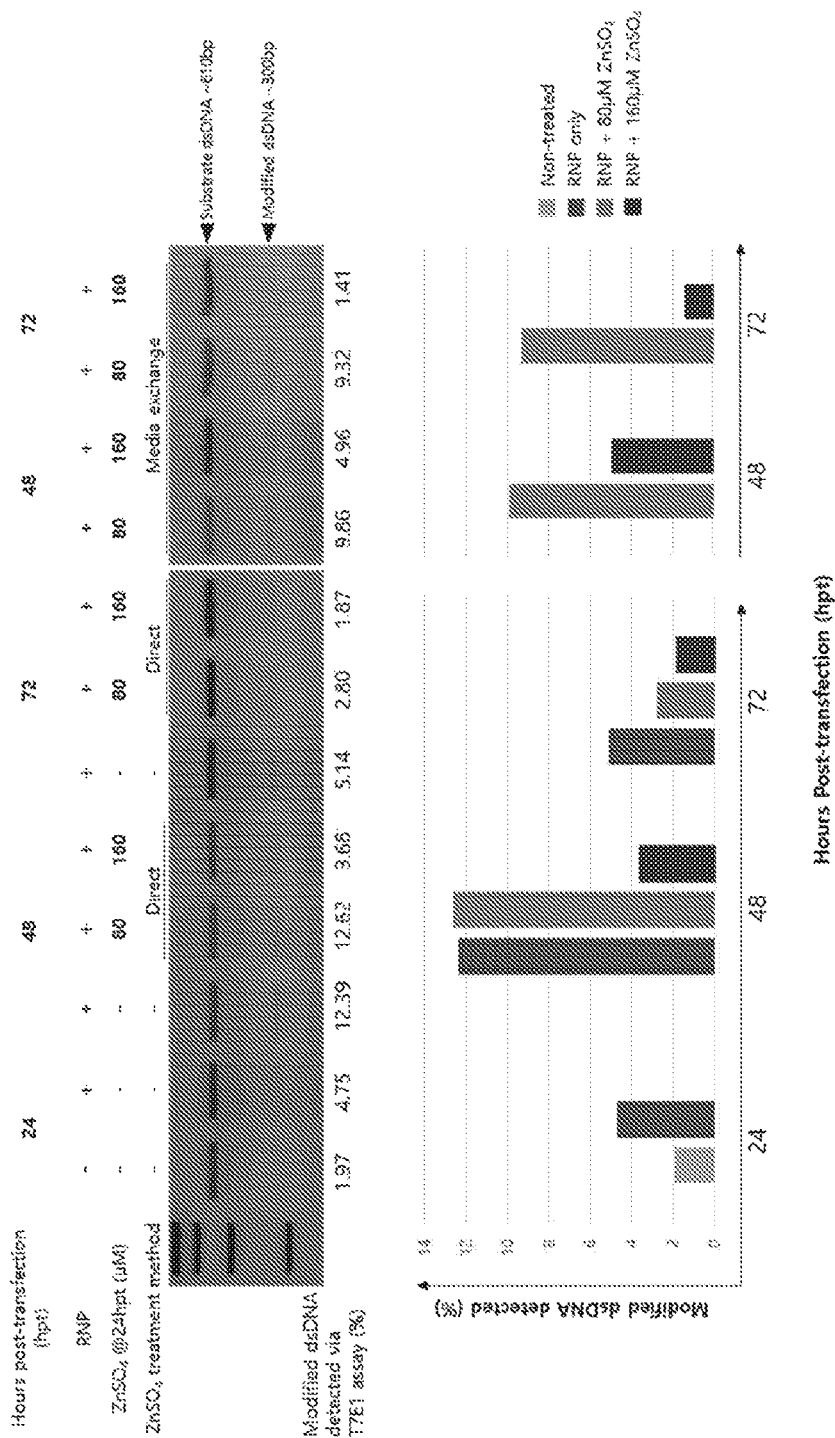

FIG. 135 shows in vitro cleavage assay after zinc sulfate treatment. The concentrations of 80 mM 160 mM of zinc sulfate were treated in HEK293 with Cas9 variants. HEK293 cells were harvested at 12 h, 24 h, and 48 h after zinc sulfate treatment. In terms of RNP treatment, HEK293 cells were harvested at 24 h, 36 h, and 60 h. Top right panel showed the results when media exchanged. The genome editing efficacy was reduced after zinc sulfate treatment.

FIG. 136 illustrates gene editing efficiency in N. benthamiana protoplasts. Each Cas9 variant and the same guide RNA against the same loci of N. benthamiana FucT13_1 and NbFucT13_3 were transfected to protoplasts of 4-week-old leaves of N. benthamiana. The protoplasts using PEG-mediated transfection method. Cells were harvested at 48 h after transfection, and then genomic DNA was extraction. Cas9-RecJ had 2-3 fold higher genome editing efficiency than Cas9 alone. At left is the negative control; the Cas9 bars are Cas9 applied samples, the Cas9-RecJ bars are Cas9-RecJ applied samples.

Figure 137:
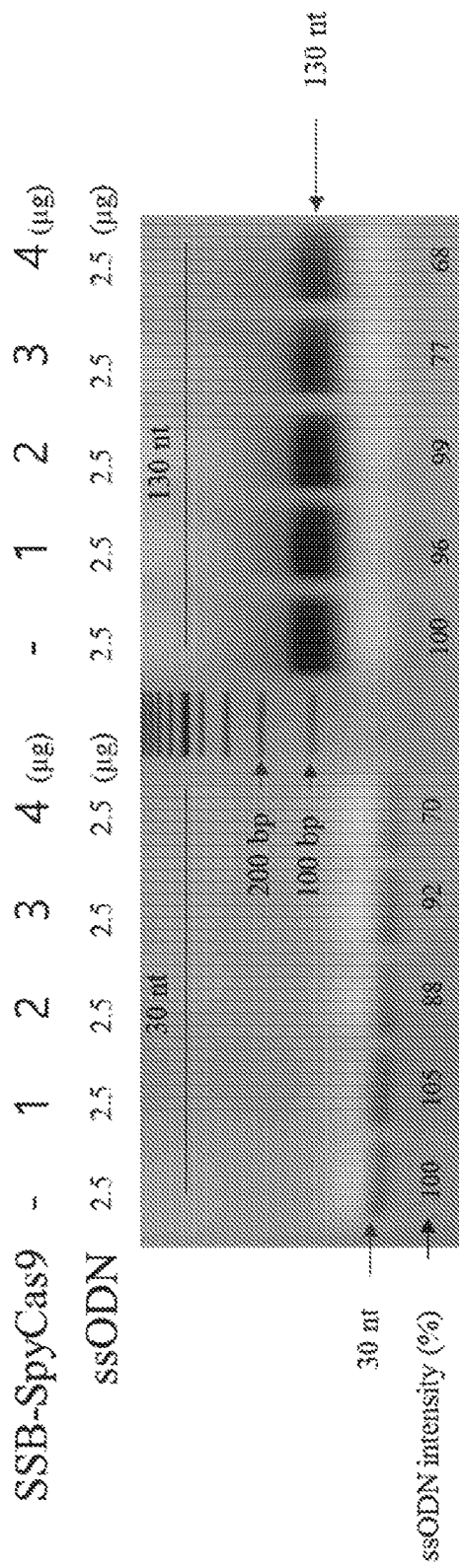

FIG. 137 illustrates binding affinity measurement between SSB-SpyCas9 protein and single stranded oligonucleotides (ssODN). SSB-SpyCas9 protein was tested to bind to ssODN in vitro condition. SSB-SpyCas9 protein amount was used with increasing gradually from 1 µg to 4 µg with 2.5 µg of ssODNs, which used two different sizes, 30 nt and 130 nt, respectively. For 10 min incubation, and then the reaction mixtures were subjected to electrophoresis. The ssODN intensities decreased by 30% along with increase of SSB-SpyCas9 protein dose. This result indicates that ssODN forms complex with SSB-SpyCas9 protein.

Figure 138:
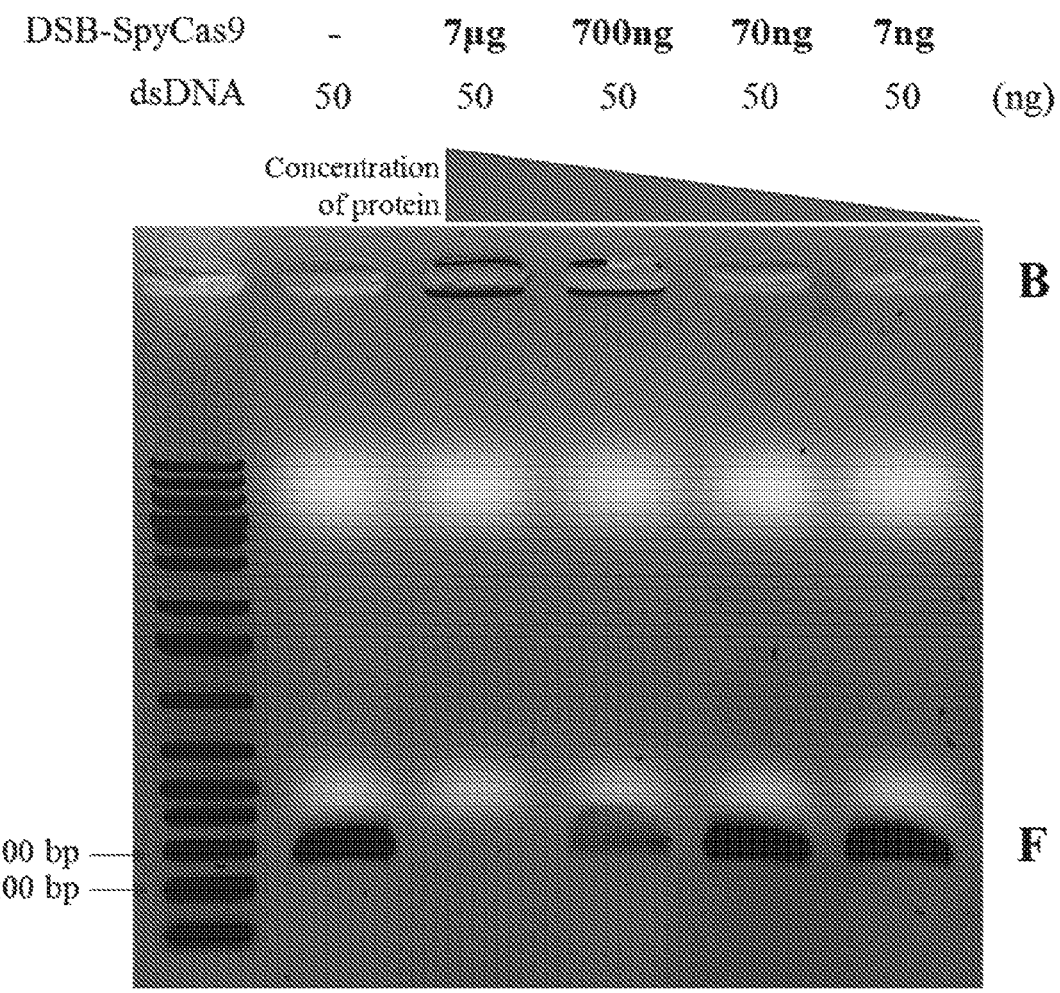

FIG. 138 illustrates binding affinity measurement between DSB-SpyCas9 protein and double stranded DNA (dsDNA). DSB-SpyCas9 protein was tested to bind to dsDNA in vitro condition. DSB-SpyCas9 protein amount was used with decreasing gradually from 7 µg to 7 ng with 50 ng of dsDNA (253 bp). The dsDNA intensities decreased along with increase of DSB-SpyCas9 protein dose. Decreased intensity of free DNA suggests that DNA forms complex with DSB-SpyCas9 proteins. Band designations: F, free DNA; B, protein-DNA complex FIG. 139 illustrates a comparison of knock-out and knock-in efficiencies among SpyCas9, DSB-SpyCas9, and DSB-SpyCas9-RecJ. SpyCas9, DSB-SpyCas9, and DSB-SpyCas9-RecJ show different genome editing efficiency.

Figure 140:
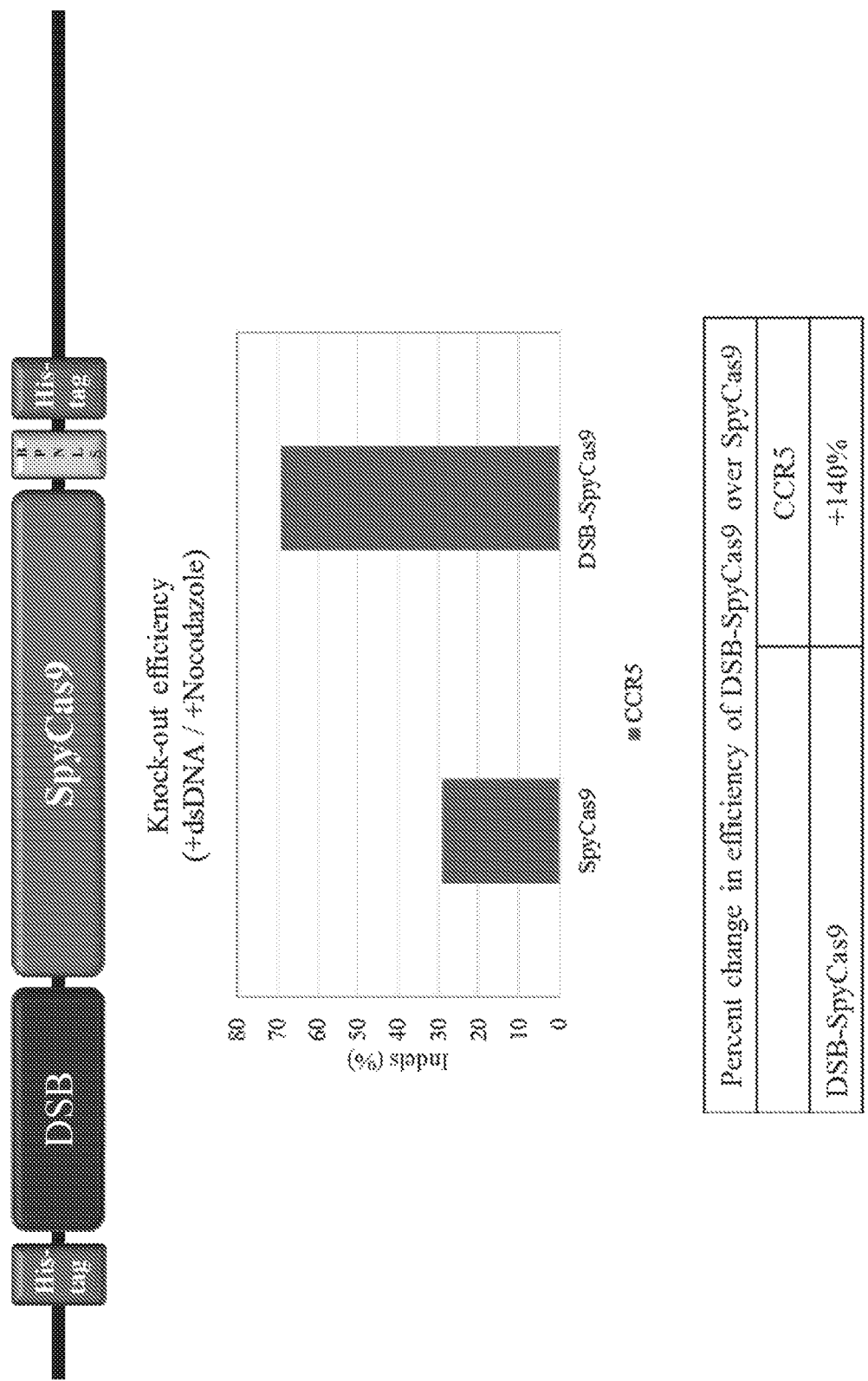

FIG. 140 illustrates a comparison of knock-out efficiencies between SpyCas9 and DSB-SpyCas9. (A) Schematic of DSB-SpyCas9 construct. (B) Editing efficiency at SpyCas9 and DSB-SpyCas9 treatment with addition of dsDNA and nocodazole. (C) Percent change in efficiency of DSB-SpyCas9 over SpyCas9.

Figure 141:
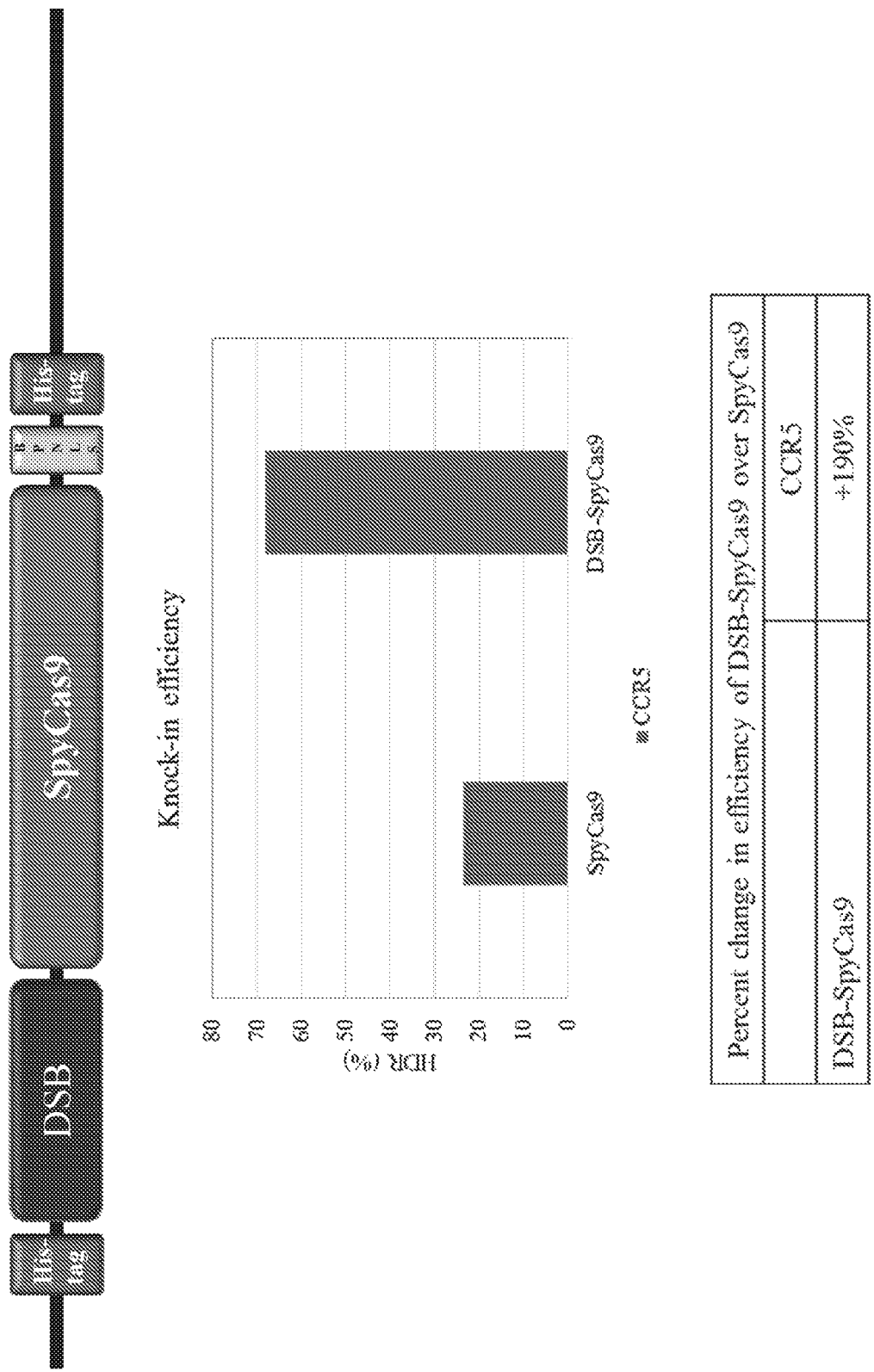

FIG. 141 illustrates a comparison of knock-in efficiencies between SpyCas9 and DSB-SpyCas9. (A) Schematic of DSB-SpyCas9 construct. (B) Editing efficiency at SpyCas9 and DSB-SpyCas9 treatment. (C) Percent change in efficiency of DSB-SpyCas9 over SpyCas9.

DETAILED DESCRIPTION

CRISPR/Cas9-based genome editing (GE) tools promise unprecedentedly bright future in biotechnology in that it accelerates development of human disease therapeutics, agricultural traits, and industrial microorganisms. Capability of CRISPR/Cas9-based GE depends on site-specific cleavage of the double stranded DNA by RNA-guided endonucleases such as Cas9 and Cpf1, and subsequent repair mechanisms. Action of CRISPR GE enzymes results in three major outcomes: 1) error-free non-homologous end joining (NHEJ), error-prone NHEJ, and homology-dependent recombination (HR) in the presence of repair templates. Homology-depended recombination can be referred in several ways, which are commonly accepted. For example, homology-dependent recombination can be referred to as "homology-directed repair" or may be abbreviated as "HR" or "HDR." Due to outperformance of error-free repair mechanisms, the apparent rates of mutations and HR after the action of CRISPR GE tools are relatively low in vivo.

To enhance both the rate of indel mutation and HR recombination, presented herein are variants of CRISPR genome editing (GE) tools, also referred to as "chimeric polypeptides", "variants", "fusions", or "fusion constructs" comprising translational fusion of DNA modifying enzymes (DME), DNA binding protein (DBP), or terminal deoxyribonucleotidyl transferase (TdT) at either upstream or downstream of CRISPR GE enzymes. In one embodiment, a variant irreversibly deleted the DNA at the CRISPR enzyme-dependent double strand break sites in 5' to 3' direction, and the resulting modified ends with 3'-OH overhang can better serve HR repairs in presence of repair template. The current inventions includes functional enhancement of the CRISPR-Cas enzymes. Disclosed herein are possible variants and their intended improvements.

The editing efficiency of CRISPR/Cas9 genome editing systems exhibit varying degrees depending on the biological systems under examined (Liu et al., 2017; Bortesi et al., 2015). The parameters most affecting the efficiency can includes detection method of the mutations, expression of the effector proteins and guide RNA, methods of delivery into the cells, forms of GE enzymes like DNA plasmid, RNAs, or pre-assembled ribonucleoproteins, and so on. Overall, the efficiency of DNA-based CRISPR-Cas9 NHEJ ranges 10 to 20% in transient expression system of plants.

Using the chimeric polypeptides of the present disclosure, also referred herein as "fusions" or "genome editing constructs" or "polypeptides", when stably transformed, the efficiency of CRISPR/Cas9 mediated NHEJ increased up to 30-40%. This may be due to prolonged exposure of the genome to continuously translated Cas9 ribonucleoproteins.

In some embodiments, any Cas9 enzymes are used in the chimeric polypeptides of the present disclosure. For example, the Cas9 may be a Streptococcus pyogenes Cas9, referred to herein as "SpyCas9" or "SpCas9". Alternatively, variants or homologs of any Cas9 protein or Cas9 proteins from other species are also consistent with the present disclosure. Alternatively, any Cas protein, such as a Cas12 or a Cas14, or any other RNA guided endonuclease can be used in the chimeric polypeptides of the present disclosure and is consistent with the methods disclosed herein.

Exceptionally, when pre-assembled CRISPR/Cas9 RNPs were administered to lettuce protoplasts, the efficiency reached as high as 46% (Woo et al., 2015). However, in the protoplast experiments with grape and apple, RNP delivery to protoplasts scored only 0.1% and 6.9%, respectively (Malony et al., 2016). Also, administration with Cas9 mRNA showed the efficiency only 1.1% (Zhang et al., 2016).

Overall, relatively low efficiency of error-prone mutation in CRISPR/Cas9-mediated NHEJ process awaits breakthrough technology to overcome the genome editing hurdles.

Here, we propose a genus of compositions comprising at least 32 representative molecules (also referred to as "variants", "chimeric polypeptides", "polypeptides", "fusions", or "fusion constructs") including Cas9-MBN, that Mungbean nuclease (MBN) from *Vigna radiata* is translationally fused to C-terminus of Cas9 protein. We designed the MBN fusion to harness its irreversible DNA resection activity at the single-strand DNAs that are generated after the Cas9 action. Once a portion of DNA is deleted before onset of NHEJ process, it inevitably causes deletion mutations at the target site. In some embodiments the polypeptides disclosed herein, including a wide range of DNA modifying enzymes coupled to CRIPSR/Cas enzymes, can improve the efficiency of NHEJ from 1% to 5%, 5% to 10%, 10% to 15%, 15% to 20%, 20% to 25%, 25% to 30%, 30% to 35%, 35% to 40%, 40% to 45%, 45% to 50%, 50% to 55%, 55% to 60%, 60% to 65%, 65% to 70%, 70% to 75%, 75% to 80%, 80% to 85%, 85% to 90%, 90% to 95%, 95% to 100%, 1% to 20%, 10% to 40%, 30% to 50%, 20% to 60%, 30% to 90%, 1% to 100%, or 50% to 90%.

In addition to MBN, we aimed to fuse many different DME as summarized in Tables 1 and 2. The DME includes many types of 5' to 3' exonuclease, 3' to 5' exonuclease, enzymes removing single-stranded DNA extensions, terminal deoxyribonucleotidyl transferase, single stranded DNA binding proteins (SSB), and double stranded DNA binding proteins (DSB). The DMEs harness the single-/double-stranded DNA resection and nucleotide insertion activity at the DSB sites to enhance the efficiency of error-prone mutation in CRISPR/Cas9-mediated NHEJ process. The SSB and DSB increase the efficiency of HR repair processes by stimulating the delivery of template DNA for HR.

In particular, fusions of SSB, or related domains, to a CRISPR/Cas enzyme (e.g., CRISPR/Cas9), can increase the efficiency of HDR after in vivo transfection. For example, in vivo transfection can be analyzed for HDR by EcoRI restriction digestion. Any cells can be cultured and evaluated for transfection. For example, primary cells can be used as well as immortalized cell lines, As an example, HEK293T cells are cultured in Dulbecco's modified Eagle's medium (DMEM) supplemented with 10% fetal bovine serum, penicillin, and streptomycin.

RNP preparation and electroporation may be carried out as follows. Before transfection to the cells, purified SpyCas9, SSB-SpyCas9, and SSB-SpyCas9-RecJ protein (33 pmol) and DHCR7 sgRNA (66 pmol) are incubated at RT for 20 minutes for RNP complex. 2 or 20 pmols of 56 mer ssODN (CCTCGCAGGGAGGTGGACTGGTTTTGAATTCCACTGGCGAGCGTCATCTTCCTACT (SEQ ID NO: 63)) are then added to RNP complex. In some embodiments, SSB in the above described fusions can be any variant of SSB, a homolog, or any domain functionally equivalent to SSB may be used. Nucleofection of HEK293T cells is performed using Lonza. Each nucleofection reaction consists of approximately $2\times10^5$ cells in 20 μl of nucleofection reagent and is mixed with 10 μl of RNP:DNA. Various concentration of cells in various volumes may be used and mixed with various volumes of RNP:DNA. For example, if being performed in cell, culture $1\times10^4$ cells, $5\times10^5$ cells, $1\times10^6$ cells, $5\times10^6$ cells, $1\times10^7$ cells, $5\times10^7$ cells, $1\times10^8$ cells, $5\times10^8$ cells, or $1\times10^9$ cells can be used. Genomic DNA extraction may be performed using PureLink Genomic DNA kits following the manufacture's instruction. PCR amplification of target region may be carried out as follows. A 1633 nt region of DHCR7 loci, containing the target site, is PCR amplified using the following primer set. Then, $2^{nd}$ PCR is performed using $1^{st}$ PCR product as a template. Primers are listed below. The resulting amplicons are purified using QIAquick PCR Purification kit. The PCR products are analyzed on 1% agarose gel. EcoRI may directly cleave PCR DNA containing the newly integrated EcoRI restriction sequence to detect successful HDR. The reaction may contain 10 ug of PCR products and 10 units of EcoRI in CutSmart buffer. After 2 hours of enzyme digestion at 37° C., the product is resolved on 2% agarose gel. The percentage of HDR can be calculated using ImageJ.

In vivo transfection and analysis of HDR by EcoRI restriction digestion can reveal more efficient HDR. HDR can be enhanced through the single stranded DNA binding (SSB) protein fusion to SpyCas9 at its N-terminus (SSB-SpyCas9). The SSB-SpyCas9 binds to the repair template ssODN. Ternary complex can consist of the ssODN, SSB-SpyCas9, and sgRNA can result in "Deliver to Repair" even with relatively tiny amount of the ssODN DNA. In some cases, HDR occur more efficiently than that of control group due to local availability of the ssODN, since SSB protein will bring ssODN at the place where double stand break occurs. HDR can be enhanced by at least 1%, at least 2%, at least 5%, at least 10%, at least 20%, at least 30%, at least 40%, at least 50%, at least 60%, at least 70%, at least 80%, at least 90%, or at least 100% as compared to HDR upon transfection of a CRISPR/Cas9 moiety alone.

Depending on the accessary proteins attached to the Cas9 or Cpf1, functions of the CRISPR-Cas GE enzymes were augmented. Overall, the novel enzymes were designed to increase the efficiency of indel mutations and HR repair processes in conventional CRISPR-Cas9 mediated GE. In some embodiments, the efficiency of indel mutations resulting from the novel chimeric polypeptides disclosed herein may be increased by 1% to 5%, 5% to 10%, 10% to 15%, 15% to 20%, 20% to 25%, 25% to 30%, 30% to 35%, 35% to 40%, 40% to 45%, 45% to 50%, 50% to 55%, 55% to 60%, 60% to 65%, 65% to 70%, 70% to 75%, 75% to 80%, 80% to 85%, 85% to 90%, 90% to 95%, 95% to 100%, 1% to 20%, 10% to 40%, 30% to 50%, 20% to 60%, 30% to 90%, 1% to 100%, or 50% to 90% as compared to conventional CRISPR-Cas9 mediated GE. Additionally, in some cases, the efficiency of the HR repair process resulting from the novel chimeric polypeptides disclosed herein may be increased by 1% to 5%, 5% to 10%, 10% to 15%, 15% to 20%, 20% to 25%, 25% to 30%, 30% to 35%, 35% to 40%, 40% to 45%, 45% to 50%, 50% to 55%, 55% to 60%, 60% to 65%, 65% to 70%, 70% to 75%, 75% to 80%, 80% to 85%, 85% to 90%, 90% to 95%, 95% to 100%, 1% to 20%, 10% to 40%, 30% to 50%, 20% to 60%, 30% to 90%, 1% to 100%, or 50% to 90% as compared to conventional CRISPR-Cas9 mediated GE.

Genome editing enzymes including meganucleases, Zinc-Finger nucleases (ZFNs), and transcription activator-like effector nucleases (TALENs) are all composed of two functional components: protein domains addressing the GE enzymes to specific sequences and DNA-cleaving enzyme like Fok I (Gaj et al., 2013). These chimeric nucleases facilitate genome engineering by inducing DNA double strand breaks (DSBs) with sequence-specific manner.

DNA-binding domains of ZFNs come from Zinc-finger type transcription factor proteins. The DNA binding domains are engineered to bind specifically the DNA sequence flanking the intended site of DSB. The Fok I nuclease domain cleave the target DNA sequence when dimerized with another Fok I domain bound in tandem. A pair of ZFNs recognizes 18 to 36 bp DNA sequences, which contributes to high specificities of this enzyme (Modares et a., 2017).

TALENs, the second-generation programmable nucleases, consist of a nuclease domain derived from FokI, and employs DNA binding domains derived from transcription activator-like (TAL) effectors of the plant pathogen *Xanthomonas* sp. Like ZFN, TALENs cleave the target DNA sequences using artificially fused DNA-cleaving enzyme Fok I. TALENs recognize 30 to 40 bp DNA sequences, and they can be programmed to target almost any DNA sequence, which represents a significant benefit over ZFNs (Kanchiswamy et al., 2016).

The latest SSN is CRISPR-Cas GE enzymes dubbed Clustered Regularly Interspaced Short Palindromic Repeats (CRISPR)—CRISPR Associated System (Cas). Of the two CRISPR-Cas classes, class II includes the single-polypeptide effector proteins such as Cas9, Cpf1, C2C2, and Cas13 (Makarova et al., 2015; Shmakov et al., 2017). Of these, CRISPR/Cas9 belonging to Class 2 Type II, was discovered as part of bacterial adaptive immune system against infecting foreign genetic elements like bacteriophage. The CRISPR/Cas9 effector proteins are placed on and cleave the target foreign DNAs. Recognition of the target sequences is possible because the pieces of the previously infected viral DNA are saved in the bacterial genome as CRISPR array, which transcribes into crRNA and this associates with the Cas9 effector protein to form functional DNA cleaving enzymes. When bound to their target sequences, the ribonucleoprotein (RNP) complex of Cas9 and single guide RNA (sgRNA, physically fused form of the two separate RNAs of crRNA and tracrRNA) cleave the target DNA to result in a blunt-ended, double-stranded break upstream of the 5'-NGG-3' protospacer-adjacent motif (PAM) sequence (Jinek et al., 2012).

Another example of class 2 CRISPR system assigned to type V, Cpf1, originates from *Prevotella* and *Francisella*. Different from Cas9, Cpf1 requires just one piece of RNA for addressing the RNP complex to specific locus, and the RNP cuts the target DNA with staggered ends rather than blunt ends Site-specific cleavage of target DNA in a cell by genome editing proteins triggers DNA repair pathways such as non-homologous end-joining (NHEJ) and homology-directed repair. There can be three major outcomes of the repair process: 1) error-free NHEJ, 2) error-prone NHEJ, and 3) homology-dependent recombination (HR) in the presence of repair templates. Error-free NHEJ repairs the target DNA and results in restoration of the original DNA sequence without producing any mutagenesis in the target DNA. On the other hand, error-prone NHEJ results in the target DNA having mutations such as frameshift mutations, relative to the original DNA sequence. FIG. 1 illustrates role of NHEJ repair process in CRISPR/Cas mediated genome editing. A ribonucleoprotein (RNP) complex comprising Cas9 effector protein and bipartite RNA comprising tracrRNA and guide RNA finds a target sequence complementary to the guide RNA. Endonuclease domains, HNH and RuvCII, in the Cas9 cut the DNA three bases upstream from PAM (5'-NGG-3') sequences to result in a double-strand break. The double-strand break is repaired by non-homologous end joining (NHEJ) process. NHEJ frequently causes error-prone ligation, but majority of the double-strand breaks are repaired seamlessly without insertion or deletion mutations. Due to outperformance of error-free repair mechanisms, the apparent rates of mutations and HR after the action of genome editing proteins are relatively low in vivo.

Disclosed herein are compositions and methods comprising engineered chimeric polypeptides to improve efficiency of genome editing. Practice of some parts of the disclosure herein achieves increased error-prone NHEJ efficiency. Practice of some parts of the disclosure herein achieves increased mutation efficiency. Practice of some parts of the disclosure herein achieves increased homologous recombination efficiency. Practice of some parts of the disclosure herein achieves lower rate of off-target mutations. Practice of some parts of the disclosure facilitates detection of off-target cleavage sites.

An exemplary chimeric polypeptide of the disclosure comprises a nuclease such as a site-specific endonuclease or a domain thereof. Non-limiting exemplary site-specific endonucleases that are suitable with the present disclosure include but are not limited to CRISPR-associated (Cas) polypeptides or Cas nucleases including Class 1 Cas polypeptides, Class 2 Cas polypeptides, type I Cas polypeptides, type II Cas polypeptides, type III Cas polypeptides, type IV Cas polypeptides, type V Cas polypeptides, and type VI CRISPR-associated (Cas) polypeptides; zinc finger nucleases (ZFN); transcription activator-like effector nucleases (TALEN); meganucleases; RNA-binding proteins (RBP); CRISPR-associated RNA binding proteins; recombinases; flippases; transposases; Argonaute (Ago) proteins (e.g., prokaryotic Argonaute (pAgo), archaeal Argonaute (aAgo), and eukaryotic Argonaute (eAgo)); any derivative thereof any variant thereof and any fragment thereof.

Some chimeric polypeptides of the disclosure comprise one or more domains of a site-specific endonuclease. Non-limiting examples of domains suitable for use with the disclosure include guide nucleic acid recognition or binding domain; nuclease domains such as DNase domain, RNase domain, RuvC domain, and HNH domain; DNA binding domain; RNA binding domain; helicase domains; protein-protein interaction domains; and dimerization domains. A guide nucleic acid recognition or binding domain interacts with a guide nucleic acid. A nuclease domain comprises catalytic activity for nucleic acid cleavage. Alternatively, a nuclease domain is a mutated nuclease domain that lacks or has reduced catalytic activity. A site-specific endonuclease can be a chimera of various site-specific endonuclease proteins, for example, comprising domains from different Cas proteins.

A site-specific endonuclease consistent with the disclosure is a wild-type form of the protein, such as a form encoded in an unaltered genome. Alternatively, some site-specific endonucleases are a modified versions of the wild-type form, for example, comprising an amino acid change such as a deletion, insertion, substitution, variant, mutation, fusion, chimera, or any combination thereof, relative to a wild-type version of the protein.

A modified site-specific endonuclease of the disclosure may comprise a polypeptide having at least about 5%, 10%, 20%, 30%, 40%, 50%, 60%, 70%, 80%, 90%, 91%, 92%, 93%, 94%, 95%, 96%, 97%, 98%, 99%, or 100% sequence identity to a wild type exemplary site-specific endonuclease.

Similarly, a modified site-specific endonuclease of the disclosure may comprise an amino acid sequence having at least about 5%, 10%, 20%, 30%, 40%, 50%, 60%, 70%, 80%, 90%, 91%, 92%, 93%, 94%, 95%, 96%, 97%, 98%, 99%, or 100% sequence identity to a nuclease domain, for example, a RuvC domain or an HNH domain, of a wild-type site-specific endonuclease.

Some site-specific endonucleases of the disclosure comprise a Cas polypeptide or a recognizable domain thereof. Non-limiting exemplary Cas polypeptides suitable for use with the present disclosure include Cas9, Cpf1, c2c1, C2c2, Cas13, c2c3, Cas1, Cas1B, Cas2, Cas3, Cas4, Cas5, Cas5e (CasD), Cas6, Cas6e, Cas6f, Cas7, Cas8a, Cas8a1, Cas8a2, Cas8b, Cas8c, Csn1, Csx12, Cas10, Cas10d, Cas1O, Cas1Od, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx1O, Csx16, CsaX, Csx3, Csx1, Csx15, Csf1, Csf2, Csf3, Csf4, and Cul966; any derivative thereof; any variant thereof; and any fragment thereof that is recognizable by one of skill in the art as arising from or comprising a recognizable portion of or activity of a protein listed above or elsewhere herein.

CRISPR/Cas9 from *Streptococcus pyogenes* (SpCas9) is relatively large-sized protein with 1,368 amino acids, and is characterized to have two endonuclease domains, HNH and RuvC, and a recognition lobe (REC) domain (Nishimasu et al. 2014). The HNH domain cleaves the DNA strand complementary to the guide RNA sequence, while the RuvC-like domain cuts the other non-complementary DNA strand through Watson-Crick base pairing by a gRNA/Cas9 complex (Jinek et al., 2012). As a result of the double stranded breaks (DSBs) by the CRISPR/Cas9 non-homologous end joining (NHEJ) process is triggered to result in error-free or error-prone insertions or deletions (indels) of DNA. Error-prone mutations lead to frameshift mutations when placed in the coding region of eukaryotic genes (Cho et al., 2013; DiCarlo et al., 2013; Belhaj et al., 2013). Cas9 has derived a series of functional alterations by introducing substitution mutations. Substitution of aspartic acid (D) at the 10th amino acid in the RuvC domain to alanine (A) removes the RuvC-dependent nuclease function leaving only HNH-dependent endonuclease function (Jinek et al., 2012; Mali et al., 2013). The D10A variant of Cas9 is used to generate a single strand nick at the target site. Additional substitution mutation, a change from histidine (H) to alanine (A) at the 840th amino acid in HNH domain of Cas9 H840A, got rid of even the nikase activity of Cas9D10A. The deactivated Cas9 (D10A and H840A) possessing only sequence-specific binding function can as a functional transcription factor when fused in frame with either an activator or a repressor domain.

Cas9 polypeptides are examples of site-specific endonuclease, as are any derivative thereof; any variant thereof; and any fragment thereof that is recognizable by one of skill in the art as arising from or comprising a recognizable portion of or activity of a protein listed above or elsewhere herein. Cas9 is classified as a class II, Type II CRISPR/Cas effector protein. An exemplary Cas9 polypeptide is Cas9 from *Streptococcus pyogenes*, referred to herein as SpCas9, which is composed of 1,368 amino acids. Cas9 is characterized to have two endonuclease domains, HNH and RuvC, and a recognition lobe (REC) domain. The HNH domain cleaves the DNA strand complementary to the guide RNA sequence. The RuvC-like domain cuts the other non-complementary DNA strand through Watson-Crick base pairing formed by a guide RNA/Cas9 complex. In some cases, a Cas9 protein comprises mutations. For example, substitution of aspartic acid (D) at the $10^{th}$ amino acid in the RuvC domain to alanine (A) removes the RuvC-dependent nuclease function leaving only HNH-dependent endonuclease function. The D10A variant of Cas9, known as a nickase, can be used to generate a single strand nick at the target site. An additional substitution mutation, a change from histidine (H) to alanine (A) at the $840^{th}$ amino acid in HNH domain of Cas9 H840A, produces a deactivated Cas9 protein lacking all nuclease activity. The deactivated Cas9, comprising mutations D10A and H840A, retains sequence-specific binding function and can serve as a functional transcription factor, for example, when fused in frame with either an activator or a repressor domain.

In some embodiments, any Cas9 enzymes are used in the chimeric polypeptides of the present disclosure. For example, the Cas9 may be a *Streptococcus pyogenes* Cas9, referred to herein as "SpyCas9" or "SpCas9". Alternatively, variants or homologs of any Cas9 protein or Cas9 proteins from other species are also consistent with the present disclosure. Alternatively, any Cas protein, such as a Cas12 (e.g., Cpf1) or a Cas14, or any other RNA guided endonuclease can be used in the chimeric polypeptides of the present disclosure and is consistent with the methods disclosed herein.

Cpf1 is classified as a class II, Type V CRISPR/Cas system containing having about 1,300 amino acids, and is a smaller and simpler endonuclease than Cas9. Cpf1 was identified later than Cas9 by metagenomic data analysis, and composed of two major domains such as REC and RuvC domains. Cpf1 does not have a HNH endonuclease domain, which is the other essential domain of Cas9 (Fagerlund et al., 2015; Zetsche et al., 2015). CRISPR/Cpf1 cleaves a double stranded DNA (dsDNA) immediate downstream from T-rich (5'-TTTN-3') PAM (Zetsche et al., 2015). CRISPR/Cpf1 generates 4-5 nt-long 5-overhang in 20 nt away from T-rich PAM, and the sticky ends enhance the efficiency of DNA replacement during HR distinct from Cas9 (Fagerlund et al., 2015; Zetsche et al., 2015).

Similarly, Cpf1 is an example of a site-specific endonuclease is Cpf1, as are any derivatives thereof, any variant thereof, and any fragment thereof that is recognizable by one of skill in the art as arising from or comprising a recognizable portion of or activity of a protein listed above or elsewhere herein. Cpf1 is classified as a class II, Type V CRISPR/Cas effector protein having about 1,300 amino acids. Cpf1 is smaller than Cas9. Cpf1 comprises two major domains such as REC and RuvC domains. Cpf1 lacks the HNH endonuclease domain. Cpf1 cleaves a double stranded DNA (dsDNA) immediately downstream from T-rich (5'-TTTN-3') PAM. Cpf1 generates a 4-5 nt-long 5'-overhang 20 nucleotides away from T-rich PAM. In some cases, the sticky ends produced by Cpf1 enhance the efficiency of DNA replacement during HR.

Exemplary site-specific endonucleases such as a Cas polypeptide are optionally derived or obtained from the organism *Streptococcus pyogenes* (*S. pyogenes*). Alternatively any of the following non-limiting examples are suitable for use as a source of the site-specific endonuclease: *Streptococcus thermophilus, Streptococcus* sp., *Staphylococcus aureus, Nocardiopsis dassonvillei, Streptomyces pristinae spiralis, Streptomyces viridochromo* genes, *Streptomyces viridochromo* genes, *Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales bacterium, Polaromonas naphthalenivorans, Polaromonas* sp., *Crocosphaera watsonii, Cyanothece* sp., *Microcystis*

*aeruginosa, Pseudomonas aeruginosa, Synechococcus* sp., *Acetohalobium arabaticum, Ammonifex degensii, Caldicelulosiruptor becscii, Candidatus Desulforudis, Clostridium botulinum, Clostridium difficile, Finegoldia magna, Natranaerobius thermophilus, Pelotomaculum thermopropionicum, Acidithiobacillus caldus, Acidithiobacillus ferrooxidans, Allochromatium vinosum, Marinobacter* sp., *Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina, Leptotrichia shahii, Prevotella,* or *Francisella novicida.*

The disclosure provides a guide nucleic acid for use in a CRISPR/Cas system. A guide nucleic acid such as a guide RNA binds to a Cas protein and targets the Cas protein to a specific location within a target nucleic acid. A guide nucleic acid comprises a nucleic acid-targeting segment and a Cas protein binding segment. In some cases, a guide nucleic acid comprises a single nucleic acid molecule, referred to as a single guide nucleic acid (sgRNA). Alternatively, a guide nucleic acid comprises two separate nucleic acid molecules, referred to as a double guide nucleic acid.

Some site-specific endonucleases of the disclosure comprise a zinc finger nuclease or ZFN. ZFNs are engineered cleavage inducing agents comprised of a zinc finger DNA binding domain and a double-strand-break-inducing agent domain. Recognition site specificity is conferred by the zinc finger domain, which can comprise two, three, or four zinc fingers, for example having a C2H2 structure. Zinc finger domains are amenable for designing polypeptides which specifically bind a selected polynucleotide recognition sequence. Exemplary ZFNs comprise an engineered DNA-binding zinc finger domain linked to a non-specific endonuclease domain, for example, a nuclease domain from a Type IIS endonuclease such as FokI.

Alternately or on combination, some site-specific endonucleases of the disclosure comprises a transcription activator-like effector nucleases (TALEN). TALENs are created by fusing a native or engineered transcription activator-like (TAL) effector, or functional part thereof, to the catalytic domain of an endonuclease, such as, for example, FokI. The modular TAL effector DNA binding domain allows for the design of proteins with potentially any given DNA recognition specificity.

Similarly, a site-specific endonuclease of the disclosure optionally comprises a meganuclease. A meganuclease binds and cuts specific recognition site, for example, which are about 18 bp or more.

Additional functionalities are fused to the site-specific endonuclease in some cases, such as transcriptional activator domains and transcription repressor domains.

A chimeric polypeptide of the disclosure comprises a site-specific endonuclease fused in frame to one or more accessory polypeptides. Depending on the accessory polypeptide fused to the site-specific endonuclease, the chimeric polypeptide exhibits, for example, increased mutation efficiency, increased homologous recombination efficiency, or concurrently both, relative to a wild-type version of the site-specific endonuclease. FIG. 2 illustrates exemplary chimeric polypeptide variants of the disclosure. An exemplary chimeric polypeptide of the disclosure comprises a site-specific endonuclease and one or more accessory polypeptides such as DNA modifying enzyme (DME), a DNA binding protein (DBP) such as single-stranded DNA binding (SSB) or double-stranded DNA binding (DSB) proteins, deoxyribonucleotidyl transferase (TdT), or a combination thereof fused at the N-terminus or C-terminus of the of the site-specific endonuclease. Optionally, a chimeric polypeptide additionally comprises a tag such as a tag that facilitates purification of the chimeric polypeptide at the N-terminus or C-terminus of the chimeric polypeptide. Optionally, a chimeric polypeptide additionally comprises a localization signal such as a nuclear localization signal to aid delivery of the chimeric polypeptide to a specific location in the cell. The localization signal is fused at the N-terminus or C-terminus of the chimeric polypeptide. Optionally, a linker peptide sequence is used to produce any of the fusions disclosed herein. Flexible linkers include, but are not limited to, XTEN (SGSETPGTSESATPES (SEQ ID NO: 64)), an 18-residue linker (GGS)6 (SEQ ID NO: 65), variable length (GGGGS)n (SEQ ID NO: 66), (G)n, GGSGGSGGS (SEQ ID NO: 68), GGSGGSGGSGGSGGSGGS (SEQ ID NO: 69), MKIIEQLPSA (SEQ ID NO: 70), VRHKLKRVGS (SEQ ID NO: 71), VPFLLEPDNINGKTC (SEQ ID NO: 72), GHGTGSTGSGSS (SEQ ID NO: 73), MSRPDPA (SEQ ID NO: 74), GSAGSAAGSGEF (SEQ ID NO: 75), SGSETPGTSESA (SEQ ID NO: 76), SGSETPGTSESATPES (SEQ ID NO: 64), SGSETPGTSESATPEGGSGGS (SEQ ID NO: 77), for example. Linkers are chosen in various cases so as to tether domains to one another while in some cases achieving at least one of providing substantial structural flexibility, providing a locally hydrophilic environment, providing a polypeptide that does not or is unlikely to impact folding of adjacent or distal regions of the protein, providing a readily accessible proteolytic cleavage site, providing a region that comprises a combination of at least one type of hydrophilic residue such as histidine, serine and threonine and at least one type of flexible residue such as glycine and alanine, providing a region comprising a combination of branched hydrophobic residues and branched polar hydrophilic residues, providing a region that is predominantly glycine, or other linker compatible with the remainder of the polypeptide molecule.

Table 1 shows exemplary accessory polypeptides suitable for fusion with a site-specific endonuclease to generate a chimeric polypeptide of the disclosure.

TABLE 1

| Effector | Classification | Accessory Polypeptide/ Repurposing function |
|---|---|---|
| Site-specific polypeptide such as Cas9 or Cpf1 | Resection | 5' to 3' exonuclease |
| | | 3' to 5' exonuclease |
| | | Flap strand removal |
| | Insertion | Deoxyribonucleotidyl transferase |
| | DNA binding protein | Delivery of repair template DNA |
| | | Single-stranded DNA binding (SSB) |
| | | Double-stranded DNA binding (DSB) |

The present disclosure provides various chimeric polypeptides or "fusions", which function to enhance mutagenesis by enhancing repair processes, such as NHEJ and HDR. An exemplary chimeric polypeptide of the disclosure comprises a site-specific endonuclease fused to a DNA modifying enzyme (DME) or a catalytic domain thereof. A DME enhances efficiency of error-prone NHEJ process at the double-stranded nucleic acid break sites produced by a site-specific endonuclease by, for example, harnessing DNA resection activity, nucleotide insertion activity, or a combination thereof. A DME generates a 3' OH overhang at the cleavage site generated by a site-specific endonuclease. Alternatively or in combination, a DME exposes a recessed 3' OH at a cleavage site generated by a site-specific endonuclease. Alternatively or in combination, a DME comprises an enzyme or domain comprising cleaved end resection activity.

In some cases, a DME comprises a nucleic acid end-processing enzyme or a catalytic domain thereof. Alternatively, a DME comprises a region exhibiting, for example, about 70%, 75%, 80%, 85%, 90%, 91%, 92%, 93%, 94%, 95%, 96%, 97%, 98%, or 99% identity over at least 70%, 75%, 80%, 85%, 90%, 91%, 92%, 93%, 94%, 95%, 96%, 97%, 98%, or 99% of its residues to an end-processing enzyme or catalytic domain thereof. Non-limiting examples of end-processing enzymes suitable for use with the disclosure include exonucleases such as 5'-3' exonucleases, 3'-5' exonucleases, 5'-3' alkaline exonucleases; endonucleases such as 5' flap endonucleases; helicases; phosphatases; hydrolases; template-independent DNA polymerases; and enzymes removing single-stranded nucleic acid extensions. Exemplary exonucleases of the Cas9 series and exemplary endonucleases of the Cpf1 series are shown in Table 2. A person skilled in the art recognizes that other exonucleases and endonucleases are suitable for use with the disclosure. In some cases, DMEs of the present disclosure comprise any DME, which when fused to a CRISPR/Cas9 results in the enhancement of mutagenesis, specifically NHEJ or HDR repair.

Several exonuclease DMEs are consistent with the present disclosure. The DME fused to a site-specific endonuclease comprises a 5'-3' exonuclease or a catalytic domain thereof in some cases. Non-limiting examples of 5'-3' exonucleases suitable for use with the disclosure include those from prokaryotes such as RecE, RecJ, RexB, and the exonuclease domain of DNA Polymerase I; bacteriophages such as T2, T3, T4, T5, T7, or lambda bacteriophage; and eukaryotes such as Xrn1 or ExoI 5'-exonuclease. In some cases, the mutation efficiency achieved with a chimeric polypeptide comprising 5'-3' exonuclease activity is greater than that achieved with a chimeric polypeptide comprising 3'-5' exonuclease activity.

One example of a 5' to 3' exonuclease is RecJ. RecJ was identified in *Escherichia coli*. RecJ is a processive monomeric exonuclease of 60 kD, and it degrades ssDNA in a 5' to 3' polarity in a reaction that requires Mg', resulting in degradation of DNA to mononucleotides (Lovett, 2011). RecJ nuclease can produce ssDNA with 3' overhang tails which may be bound by SSB (Ralph, 1990). RecJ does not require a terminal 5' phosphate and will digest equally well DNA terminating in 5' OH. RecJ has no activity on blunt dsDNA and requires at least 6 unpaired bases to bind and to initiate degradation (Kowalczykowski et al., 1994). Once bound to a ssDNA-tailed molecule, RecJ can digest into a dsDNA region to a limited extent but most often terminates digestion at the ds/ssDNA boundary (Lovett, 2011; Kowalczykowski et al., 1994). RecJ is specialized for degradation from a single-strand gap, then leads to produce 3' ssDNA tailed recombinogenic molecules from double-strand ends. RecJ can remove 5' overhanging ss DNA produced by 3' to 5' exonuclease activity to increase the indel mutation rate. Also, RecJ is suited to link to C-terminus of Cpf1, because RecJ chews 5-nt overhang produced by Cpf1.

Alternately, the DME fused to a site-specific endonuclease comprises RecJ or a catalytic domain thereof. RecJ is a processive monomeric exonuclease of about 60 kD. RecJ degrades ssDNA in a 5' to 3' polarity in a reaction that requires Mg', resulting in degradation of DNA to mononucleotides. RecJ nuclease can produce ssDNA with 3' overhang tails which may be bound by a single-stranded DNA binding protein. In some cases, RecJ does not require a terminal 5' phosphate and will digest equally well DNA terminating in 5' OH. In some cases, RecJ has no activity on blunt dsDNA. In some cases, RecJ requires at least 6 unpaired bases to bind and to initiate degradation. Once bound to a ssDNA-tailed molecule, RecJ can digest into a dsDNA region to a limited extent but most often terminates digestion at the ds/ssDNA boundary. RecJ is specialized for degradation from a single-strand gap, then leads to produce 3' ssDNA tailed recombinogenic molecules from double-strand ends. RecJ can remove 5' overhanging ssDNA produced by 3' to 5' exonuclease activity to increase the indel mutation rate. In some cases, RecJ is suited to link to C-terminus of a site-specific endonuclease such as Cpf1, for example, because RecJ is capable of chewing 5-nt overhang produced by Cpf1.

One example of a 5' to 3' exonuclease is RecE. Exonuclease VIII (RecE) possesses processive $Mg^{2+}$-dependent 5' to 3' exonuclease activity on dsDNA ends (Lovett, 2011) and is the functional equivalent to the lambda exonuclease. RecE is an 866 amino acid protein. RecE resects double stranded DNA from 5' to 3' direction, whereas 5' ends of single strand breaks or gaps are preferred. RecE was identified within a cryptic prophage named Rac (for recombination activation), present in *E. coli* K-12 strain. RecE requires a 5' phosphate for its exonuclease activity, and is not able to function on the ends of dsDNA without a 5' phosphate. We liked the RecE activity only the DSB generated by the action of Cas9 leaving some nicks opportunistically occurred in the genome untouched. This is important consideration to minimize the off-target effects nascent to Cas9 or Cas9-RecE enzymes. We expect that RecE can enhance both the indel mutation rate and HR by producing 3' overhangs from Cas9-produced blunt end, still leaving the nicks opportunistically occurred in off-target sites In an exemplary chimeric polypeptide, the DME fused to a site-specific endonuclease comprises RecE or a domain thereof. RecE (also known as Exonuclease VIII or ExoVIII) possesses processive $Mg^{2+}$-dependent 5' to 3' exonuclease activity. RecE is the functional equivalent to the lambda exonuclease. An exemplary source of RecE is *E. coli*. RecE is composed of about 866 amino acids. RecE resects double stranded DNA from 5' to 3' direction. RecE requires a 5' phosphate for its exonuclease activity. In some cases, RecE preferentially acts on dsDNA blunt ends, which are produced by site-specific endonucleases such as Cas9. In some cases, the RecE activity is preferable, for example, because RecE acts only on the DSB generated by the action of Cas9, leaving some nicks and single-stranded breaks occurring randomly in the genome untouched. This can be an important consideration to minimize the off-target effects nascent to Cas9 or Cas9-RecE enzymes. RecE can enhance both the indel mutation rate and HR by producing 3' overhangs from Cas9-produced blunt end, still leaving the nicks opportunistically occurred in off-target sites. Accordingly, some exonuclease activities are specific to or preferentially or differentially act upon Cas9, Cpf1 or other CRISPR-related double strand cleavage or single strand nick introduction, to the exclusion of DNA cleavage or nick events occurring elsewhere in a nucleic acid molecule.

One example of a 5' to 3' exonuclease is T5 exonuclease. Bacteriophage T5 exonuclease (T5-exo) was originally purified from phage-infected cells. T5-exo is a 276 amino acid protein. Phage T5 exonuclease has a 5'→3' exodeoxyribonuclease activity, which also possesses endonucleolytic activity a free single-stranded 5'-end. T5-exo degrades ssDNA or dsDNA in the 5' to 3' direction (Garforth and Sayers, 1997). T5-exo is able to initiate nucleotide removal from the 5' termini or at gaps and nicks of linear or circular dsDNA (Ceska et al., 1996). However, T5-exo does not degrade supercoiled circular dsDNA. T5-exo can enhance both the indel mutation and HR by producing 3'-overhangings from double strand breaks generated by Cas9.

In an exemplary chimeric polypeptide, the DME fused to a site-specific endonuclease comprises T5 exonuclease or a catalytic domain thereof. T5 exonuclease (T5-exo) is a 276 amino acid protein. T5 exonuclease has a 5'→3' exodeoxyribonuclease activity. T5 exonuclease degrades ssDNA or dsDNA in the 5' to 3' direction. T5 exonuclease is able to initiate nucleotide removal from the 5' termini or at gaps and nicks of linear or circular dsDNA. Some T5 exonuclease moieties do not degrade supercoiled circular dsDNA. T5 exonuclease can enhance indel mutation and HR by producing 3'-overhangs from double strand breaks generated by a site-specific endonuclease such as Cas9.

One example of a 5' to 3' exonuclease is lambda exonuclease. Lambda exonuclease belongs to exonuclease IV, which has exonucleolytic cleavage in the 5'- to 3'-direction to yield nucleoside 5'-phosphates. This enzyme has preference for blunt-ended, 5'-phosphorylated dsDNA. Lambda Exonuclease is unable to initiate DNA digestion at nicks or gaps (Shevelev and Hubscher, 2002). We propose that Lambda Exonuclease can enhance both the indel mutation rate and HR by producing 3' overhangs from Cas9-produced blunt end, still leaving the nicks occurred in off-target sites.

In an exemplary chimeric polypeptide, the DME fused to a site-specific endonuclease comprises Lambda exonuclease or a catalytic domain thereof. Lambda exonuclease belongs to exonuclease IV, which has exonucleolytic cleavage in the 5'- to 3'-direction to yield nucleoside 5'-phosphates. Lambda exonuclease has a preference for blunt-ended, 5'-phosphorylated dsDNA. Lambda Exonuclease is unable to initiate DNA digestion at nicks or gaps. Lambda Exonuclease can enhance both the indel mutation rate and HR by producing 3' overhangs from Cas9-produced blunt ends.

One example of a 5' to 3' exonuclease is small fragment of DNA pol I. The smaller fragment formed when DNA polymerase I from *E. coli* is cleaved by subtilisin retains the 5'→3' exonuclease and 5' flap (5' overhang extending from duplex strands) endonuclease activity but does not have the other two activities exhibited by the Klenow fragment (i.e. 5'→3' polymerase activity, and 3'→5' exonuclease activity) which is a large protein fragment produced when DNA polymerase I from *E. coli* is enzymatically cleaved by the protease subtilisin (Zhao et al., 2014).

In an exemplary chimeric polypeptide, the DME fused to a site-specific endonuclease comprises an exonuclease domain of DNA polymerase I. Cleavage of DNA polymerase I, for example, by the protease subtilisin, produces a small fragment and a large fragment (also known as the Klenow fragment). The small fragment, referred to herein as small fragment of DNA pol I, comprises 5'→3' exonuclease and 5' flap (5' overhang extending from duplex strands) endonuclease activity, and is suitable for use as a DME comprising 5'→3' exonuclease activity. The larger fragment comprises 5'→3' polymerase activity, and 3'→5' exonuclease activity.

In an exemplary chimeric polypeptide, the DME fused to a site-specific endonuclease comprises a 3'-5' exonuclease or a catalytic domain thereof. Non-limiting examples of 3'-5' exonucleases suitable for use with the disclosure include TREX such as TREX2, Mungbean nuclease, Exonuclease I, Exonuclease III, Exonuclease VII, and RecBCD exonuclease.

One example of a 3' to 5' exonuclease is TREX2. TREX2 is one of autonomous eukaryotic exonucleases, and is a 279 amino acid protein. The TREX1 and TREX2 proteins constituted homodimers, which function robust 3' excision activities. TREX1 and TREX2 employ single-stranded oligonucleotides, and most closely relate structurally with the bacterial epsilon subunit of DNA pol III, ExoI, and ExoX (Shevelev and Hubscher, 2002).

In an exemplary chimeric polypeptide, the DME fused to a site-specific endonuclease comprises TREX or a catalytic domain thereof. The TREX enzyme can be TREX1 or TREX2. TREX2 is an autonomous eukaryotic exonuclease, which is a 279 amino acid protein. The TREX1 and TREX2 proteins form homodimers with 3' excision activities. TREX1 and TREX2 employ single-stranded oligonucleotides, and most closely relate structurally with the bacterial epsilon subunit of DNA pol III, ExoI, and ExoX.

One example of a 3' to 5' exonuclease is mungbean nuclease. Mungbean nuclease is a 355 amino acid protein, isolated from sprouts of the mung bean, *Vigna radiata*, and cut-out nucleotides in a step-wise manner from ssDNA from a mixture also containing dsDNA, or a flap structure of dsDNA with a free single-stranded 5'-end, however, Mungbean exonuclease does not digest double-stranded DNA, double-stranded RNA, DNA/RNA hybrids, or the intact strand of nicked duplex DNA (McCutchan et al., 1984). Mungbean nuclease catalyzes the specific degradation of single-stranded DNA or RNA, and produces mono and oligonucleotides carrying a 5'-P terminus (Kroeker et al., 1976; Kowalski et al., 1976). Mungbean can increase indel mutation by removing both 5' and 3' single stranded overhangings produced in Cas9-producing break ends.

In an exemplary chimeric polypeptide, the DME fused to a site-specific endonuclease comprises Mungbean nuclease or a catalytic domain thereof. Mungbean nuclease is a 355 amino acid protein, isolated from the sprouts of the mung bean, *Vigna radiata*. Mungbean nuclease cleaves nucleotides in a step-wise manner from ssDNA or a flap structure of dsDNA with a free single-stranded 5'-end. In some cases, Mungbean exonuclease does not digest double-stranded DNA, double-stranded RNA, DNA/RNA hybrids, or the intact strand of nicked duplex DNA. Mungbean nuclease catalyzes the specific degradation of single-stranded DNA or RNA, and produces mono and oligonucleotides carrying a 5'-P terminus. In some cases, Mungbean exonuclease increases indel mutation by removing 5' and 3' single-stranded overhangs produced by site-specific endonucleases such as Cas9.

Another example of a 3' to 5' exonuclease is exonuclease I. Exonuclease 1 is an 846 amino acid protein with a $Mg^{2+}$-dependent 3' to 5' single strand exonuclease activity. Exonuclease I was the first exonuclease to be purified and characterized from *E. coli* and digests dsDNA to mononucleotides. ExoI is a member of the DnaQ superfamily and its structure is highly similar to the 3' to 5' exonucleases active site of the Klenow fragment of DNA polymerase I (Lovett, 2011; Kowalczykowski et al., 1994). ExoI can increase the indel mutation by removing ss overhangings in double strand break ends produced by Cas9

In an exemplary chimeric polypeptide, the DME fused to a site-specific endonuclease comprises exonuclease I or a catalytic domain thereof. Exonuclease 1 (ExoI) is an 846 amino acid protein with a $Mg^{2+}$-dependent 3' to 5' single strand exonuclease activity. Exonuclease I digests dsDNA to mononucleotides. Exonuclease I is a member of the DnaQ superfamily and its structure is similar to the 3' to 5' exonucleases active site of the Klenow fragment of DNA polymerase I. In some cases, Exonuclease I increases the indel mutation by removing single stranded overhang in double strand break ends produced by site-specific endonucleases such as Cas9.

Another example of a 3' to 5' exonuclease is exonuclease III (Exo III working on dsDNA). Exonuclease III catalyzes the stepwise removal of mononucleotides from 3'-hydroxyl termini of double-stranded DNA (Shevelev and Hubscher, 2002). The preferred substrates are blunt or recessed 3'-terminus. Exo III also acts at nicks in duplex DNA to produce single-strand gaps, which are resistant to cleavage because Exo III is not active on 3'-overhang termini with extensions 4 bases or longer being essentially resistant to cleavage (Lovett, 2011; Kowalczykowski et al., 1994). Exo III produces unidirectional deletions from a linear molecule with one 3'-overhang resistant and one 5'-overhang or blunt susceptible terminus. Exo III activity depends partially on the DNA helical structure and displays sequence dependence (C>A=T>G). ExoIII has also been reported to have RNase H, 3'-phosphatase and AP-endonuclease activities (Lovett, 2011; Kowalczykowski et al., 1994). Exo III increase the indel mutation by accelerating the 3' to 5' exonuclease activity of Cas9.

In an exemplary chimeric polypeptide, the DME fused to a site-specific endonuclease comprises exonuclease III (ExoIII) or a catalytic domain thereof. Exonuclease III catalyzes the stepwise removal of mononucleotides from 3'-hydroxyl termini of double-stranded DNA. Exemplary substrates of exonuclease III are blunt or recessed 3'-termini. In some cases, Exonuclease III also acts at nicks in duplex DNA to produce single-strand gaps, which can be resistant to cleavage, because often Exonuclease III may not be active on 3'-overhang termini with extensions 4 bases or longer being frequently resistant to cleavage. Exonuclease III produces unidirectional deletions from a linear molecule with one 3'-overhang resistant and one 5'-overhang or blunt susceptible terminus. Exonuclease III activity depends partially on the DNA helical structure and displays sequence dependence (C>A=T>G). Exonuclease III can also comprise RNase H, 3'-phosphatase and AP-endonuclease activities. In some cases, Exonuclease III increases indel mutations by accelerating the 3' to 5' exonuclease activity of Cas9.

Another example of a 3' to 5' exonuclease is exonuclease VII. Exonuclease VII is an *Escherichia coli* exonuclease enzyme, which is composed of two nonidentical subunits; one large subunit and four small ones. Exonuclease VII cleaved ssDNA from either 5'-3' or 3'-5' direction to yield 5'-phosphomononucleotides. The large subunit also contains an N-terminal DNA binding domain (Shevelev and Hubscher, 2002). Exo VII increase the indel mutation by removing ss overhangs generated in Cas9-producing break ends.

In an exemplary chimeric polypeptide, the DME fused to a site-specific endonuclease comprises exonuclease VII or a catalytic domain thereof. Exonuclease VII (ExoVII) cleaves single-stranded DNA from either 5'-3' or 3'-5' direction to yield 5'-phosphomononucleotides. Exonuclease VII also comprises an N-terminal DNA binding domain. In some cases, Exonuclease VII increases indel mutations by removing single stranded overhangs generated by Cas9-producing break ends.

Another example of a 3' to 5' exonuclease is RecBCD exonuclease. RecBCD exonuclease was isolated from *E. coli*, and composed of $Mg^{2+}$-dependent RecB domain, RecC domain, and RecD domain, which unwind dsDNA and degrade ssDNA and dsDNA. RecBCD cleaved ssDNA from either 5'-3' or 3'-5' direction to yield 5'-phosphomononucleotides (Lovett, 2011; Kowalczykowski et al., 1994; Shevelev and Hubscher, 2002). RecBCD increase the indel mutation by removing ss overhangings generated in Cas9-producing double strand breaks.

In an exemplary chimeric polypeptide, the DME fused to a site-specific endonuclease comprises RecBCD exonuclease or a catalytic domain thereof. RecBCD exonuclease comprises a $Mg^{2+}$-dependent RecB domain, RecC domain, and RecD domain, which unwind dsDNA and degrade single-stranded DNA and double-stranded DNA. RecBCD cleaves ssDNA from either 5'-3' or 3'-5' direction to yield 5'-phosphomononucleotides. In some cases, RecBCD increases indel mutation by removing single-stranded overhangs generated in Cas9-based double strand breaks.

One example of a terminal DNA transferase is DNTT (DNA nucleotidylexotransferase). Human terminal deoxynucleotidyl transferase (TdT), a template-independent DNA polymerase with 509 amino acids, catalyzes the random polymerization of deoxynucleoside 5'-triphosphates to the 3'-OH of a DNA initiator (Yang et al., 1994). We thought that Cas9-TdT can label DSB with BrdU, which results in easy-detection off-target sites produced by unintended Cas9 side effect as well as insertional mutation in Cas9-producing double strand breaks.

In an exemplary chimeric polypeptide, a site-specific endonuclease is fused to a terminal DNA transferase (DNTT) or a catalytic domain thereof. DNTT from *Homo sapiens, Pan troglodytes, Macaca mulatta, Canis lupus familiaris, Bos taurus, Mus musculus, Rattus norvegicus, Gallus gallus, Xenopus tropicalis*, and *Danio rerio* can be used, for example. Any DNTT isoform can be used. An exemplary terminal DNA transferase suitable for use with the disclosure is terminal deoxynucleotidyl transferase (TdT). TdT is a template-independent DNA polymerase. TdT catalyzes the random polymerization of deoxynucleoside 5'-triphosphates to the 3'-OH of a DNA initiator. In some cases, the TdT is from a human source. Human TdT is a 509 amino acid protein.

In an exemplary chimeric polypeptide, a site-specific endonuclease is fused to a DNA binding protein (DBP) or a domain thereof. DBPs suitable for use with the disclosure include those that bind to single-stranded DNA, double-stranded DNA, or a combination thereof.

Another example of a terminal DNA transferase is a single strand binding domain (SSB). SSB could be isolated from *E. coli*, and it binds to ssDNA. The SSB protein stimulates RecA protein-promoted pairing, traps ssDNA produced by DNA helicase activity, and protects ssDNA from nucleolytic degradation in the process of genetic recombination (Kowalczykowski et al., 1994). SSB can increase indel mutation by promoting the insertion of oligo DNA fragments and enhance the HR by enhancing the delivery and stability of single strand DNAs that are used for HR process.

In an exemplary chimeric polypeptide, a site-specific endonuclease is fused to a DBP that binds to single-stranded DNA, also referred to herein as a single-stranded DNA binding (SSB) protein. An exemplary source of SSB proteins is *E. coli*. SSB proteins stimulate RecA protein-promoted pairing, trap ssDNA produced by DNA helicase activity, and protects ssDNA from nucleolytic degradation in the process of genetic recombination. SSB proteins increase indel mutation, for example, by promoting the insertion of oligo DNA fragments. Alternatively, or in combination, SSB proteins enhance HR by enhancing the delivery and stability of single-strand DNAs that are used for the HR process.

Another example of a terminal DNA transferase is a double strand binding domain (DSB). A DSB binds double-stranded DNA, and interacts preferentially with T4 late promoter regions (Gansz et al., 1991). DSB can increase indel mutation by providing ds DNA fragments at Cas9-dependent cleavage site and enhance the HR by enhancing the delivery and stability of ds repair DNAs that are essential for HR process at cleavage sites.

In an exemplary chimeric polypeptide, a site-specific endonuclease is fused to a DBP that binds to double-stranded DNA, also referred to herein as a double-stranded DNA binding (DSB) protein. DSB proteins interact preferentially with T4 late promoter regions. DSB increases indel mutation, for example, by providing dsDNA fragments at site-specific endonuclease-dependent cleavage sites. Alternatively or in combination, DSB enhances HR, for example, by enhancing the delivery and stability of repair or template nucleic acids required for HR process at cleavage sites.

The chimeric polypeptide variants described herein do not exhibit off-target mutagenesis at any higher rates than standard CRIPSR Cas9 enzymes. In some cases, chimeric polypeptide variants described herein exhibit the same or lower off target effects than standard CRISPR Cas9 enzymes. This, the chimeric polypeptides described herein exhibit higher, or increased, on-target mutagenesis, either via NHEJ repair processes and increased percent indels or increased HR, without increasing off-target mutagenesis as compared to standard CRIPSR Cas9 enzymes. Based on whole genome sequencing, there were no significant values of off-target effect detected between Cas9 and Cas9-RecJ treatment. Cas9-RecJ had lower off-targeting efficiency for three regions, KCNJ6, CNTPNA2, and Ch.5 except ADCY5 in amplicon deep sequencing. Thus, the present disclosure provides, for example, an elevated rate of target specific frameshift mutation, without exhibiting an off-target mutagenesis rate that differs significantly from Cas9 or exhibits an off-target mutagenesis rate that is significantly lower from Cas9. In some embodiments, the off-target mutations that are introduced are point mutations, such as transitions or transversions.

The exemplary chimeric polypeptide variants disclosed herein were tested for genome wide off target variants, and, as seen in the below table, said chimeric polypeptides did not significantly vary in the number of insertions and deletions.

TABLE 2

| Sample ID | Row Sequence depth | Depth (std) | Coverage 1x rate (%) | Coverage 5x rate (%) | Coverage 10x rate (%) | Coverage 20x rate (%) | Coverage 50x rate (%) |
|---|---|---|---|---|---|---|---|
| GFLAS01 | 15.69 | 25.53 (110.58) | 47.65 | 47.56 | 47.11 | 36.89 | 1.31 |
| GFLAS02 | 15.64 | 25.21 (105.60) | 47.64 | 47.54 | 46.94 | 35.82 | 1.31 |
| GFLAS03 | 15.80 | 25.36 (111.05) | 47.64 | 47.53 | 46.92 | 36.02 | 1.35 |
| GFLAS04 | 16.58 | 25.38 (105.23) | 47.64 | 47.54 | 46.92 | 35.98 | 1.41 |
| GFLAS05 | 17.75 | 27.07 (108.41) | 47.65 | 47.56 | 47.1 | 37.95 | 2.12 |
| GFLAS06 | 18.99 | 28.84 (117.72) | 47.65 | 47.56 | 47.25 | 40.14 | 2.92 |
| GFLAS07 | 18.80 | 28.09 (110.23) | 47.65 | 47.57 | 47.21 | 39.25 | 2.64 |

None of the above tested chimeric polypeptides had off-site mutations any more than controls in any category of mutations at any types of loci.

As shown in the table below, different categories of genomic regions such as downstream, exon, intergenic, intron, splice site acceptor, splice site donor, splice site region, transcript, upstream, and UTRs were evaluated for off-target mutagenesis using chimeric polypeptides of the present disclosure as compared to a relative control, and no bias was observed.

TABLE 3

| Sample ID | DOWNSTREAM | EXON | INTERGENIC | INTRON | SPLICE_SITE_ACCEPTOR | SPLICE_SITE_DONOR |
|---|---|---|---|---|---|---|
| GFLAS01 | 400,029 | 70,100 | 2,836,902 | 4,063,129 | 271 | 232 |
| GFLAS02 | 400,629 | 70,326 | 2,824,061 | 4,058,532 | 260 | 243 |
| GFLAS03 | 400,176 | 70,558 | 2,820,774 | 4,044,879 | 270 | 235 |
| GFLAS04 | 401,780 | 69,919 | 2,832,843 | 4,065,430 | 269 | 242 |
| GFLAS05 | 362,914 | 62,647 | 2,625,714 | 3,685,800 | 249 | 212 |
| GFLAS06 | 406,455 | 70,762 | 2,860,831 | 4,105,090 | 271 | 227 |
| GFLAS07 | 371,676 | 64,909 | 2,791,384 | 3,994,188 | 262 | 220 |

TABLE 3-continued

| Sample ID | SPLICE_SITE_REGION | TRANSCRIPT | UPSTREAM | UTR_3_PRIME | UTR_5_PRIME | Total |
|---|---|---|---|---|---|---|
| GFLAS01 | 6,446 | 54 | 393,809 | 66,033 | 13,750 | 7,850,755 |
| GFLAS02 | 6,446 | 70 | 395,198 | 66,136 | 13,904 | 7,835,805 |
| GFLAS03 | 6,482 | 72 | 393,845 | 66,030 | 13,843 | 7,817,164 |
| GFLAS04 | 6,464 | 62 | 395,353 | 66,016 | 13,840 | 7,852,218 |
| GFLAS05 | 5,858 | 55 | 357,361 | 58,795 | 12,284 | 7,171,889 |
| GFLAS06 | 6,513 | 83 | 400,315 | 66,445 | 13,912 | 7,930,904 |
| GFLAS07 | 6,058 | 60 | 367,089 | 62,126 | 12,969 | 7,670,941 |

Table 4 lists exemplary chimeric polypeptide variants generated for use with the compositions and methods of the disclosure. The column headings indicate as follows: Name refers to the name of the chimeric polypeptide; Added moiety refers to abbreviated name of the accessory polypeptide fused at either N- or C-terminus of the site specific endonuclease; Origin of added moiety refers to origin of accessory polypeptide; Function of added moiety refers to illustrative biochemical function of the accessory polypeptide; Substrate DNA refers to the form of the DNA that the accessory polypeptide prefers to act on; Product refers to the DNA structure resulting from the action of chimeric polypeptide comprising the accessory polypeptide fused to the site-specific endonuclease; Intended enhancement refers to functional improvement derived from the chimeric polypeptide.

TABLE 4

| | Name | Added moiety | Representing origin of added moiety | Function of added moiety | Substrate DNA | Product | Intended enhancement | Illustrative Applications |
|---|---|---|---|---|---|---|---|---|
| | | | | Cas9 series | | | | |
| 1 | Cas9-Euk | BPNLS | Eukaryote optimized | Nuclear localization signal | dsDNA | Double strand break | Control | Knock-out & Knock-in |
| 2 | Cas9-Prok | — | *Streptococcus pyogenes* | — | dsDNA | Double strand break | Control | Knock-out & Knock-in |
| 3 | Cas9-RecE | RecE | *Escherichia coli* | 5'→3' exonuclease | dsDNA | 3' overhang | Indel and HR | Knock-out & Knock-in |
| 4 | Cas9-RecJ | RecJ | *Escherichia coli* | 5'→3' exonuclease | ssDNA | blunt end/ 5' and 3' overhang | Indel and HR | Knock-out & Knock-in |
| 5 | Cas9-T5Exo | T5 | Bacteriophage T5 | 5'→3' exonuclease | dsDNA and ssDNA | 3' overhang | Indel and HR | Knock-out & Knock-in |
| 6 | Cas9-Exo I | Exo I | *Escherichia coli* | 3'→5' exonuclease | ssDNA and oligo | blunt end/ 5' and 3' overhang | Indel and HR | Knock-out & Knock-in |
| 7 | Cas9-Exo III | Exo III | *Escherichia coli* | 3'→5' exonuclease | dsDNA, nick, blunt, 3' recessed end | 5' overhang | Indel | Knock-out |
| 8 | Cas9-Exo VII | Exo VII | *Escherichia coli* | Both 5'→3' and 3'→5' directions. | ssDNA | blunt end | Indel | Knock-out |
| 9 | Cas9-LExo | Lexo | *Escherichia coli* | Lambda exonuclease, 5'→3' exonuclease | 5'-Ⓟ blunt or recessed ends. | 3' overhang | Indel and HR | Knock-out & Knock-in |
| 10 | Cas9-RecBCD | RecBCD | *Escherichia coli* | Both 5'→3' and 3'→5' directions | dsDNA and ssDNA. | blunt end/ 5' and 3' overhang | Indel and HR | Knock-out & Knock-in |
| 11 | Cas9-MBN | Mungbean nuclease | *Vigna radiata* | Single strand DNA digestion | ssDNA | blunt end | Indel and HR | Knock-out & Knock-in |
| 12 | Cas9-SF | Small fragment of DNAPolI | *Escherichia coli* | 5'→3' exo, 5' flap removal | dsDNA/5' overhang | 3' overhang | Indel and HR | Knock-out & Knock-in |
| 13 | SSB-Cas9 | SSB | *Escherichia coli* | Single strand DNA binding protein | ssDNA | insertion | Indel/HR by delivering oligodeoxynbonucleotides bound to SSB | Knock-out & Knock-in |
| 14 | SSB-Cas9-RecE | SSB + RecE | *Escherichia coli* | Single strand DNA binding protein plus 5'→3' exonuclease | dsDNA/ssDNA | insertion | Indel/HR by delivering oligodeoxynbonucleotides bound to SSB | Knock-out & Knock-in |
| 15 | SSB-Cas9-RecJ | SSB + RecJ | *Escherichia coli* | Single strand DNA binding protein +3'→5' exonuclease | ssDNA/dsDNA | insertion | Indel/HR by delivering oligodeoxynbonucleotides bound to SSB | Knock-out & Knock-in |
| 16 | DSB-Cas9 | DSB | Bacteriophage T4 | DNA binding protein | dsDNA | insertion | Indel/HR by delivering the repair DNA bound to DSB | Knock-out & Knock-in |

TABLE 4-continued

| Name | Added moiety | Representing origin of added moiety | Function of added moiety | Substrate DNA | Product | Intended enhancement | Illustrative Applications |
|---|---|---|---|---|---|---|---|
| 17 DSB-Cas9-RecE | DSB + RecE | Bacteriophage T4 + Escherichia coli | Double strand DNA binding protein +5'→3' exonuclease | dsDNA/ssDNA | insertion | Indel/HR by delivering the repair DNA bound to DSB | Knock-out & Knock-in |
| 18 DSB-Cas9-RecJ | DSB + RecJ | Bacteriophage T4 + Escherichia coli | Double strand DNA binding protein +3'→5' exonuclease | dsDNA/ssDNA | insertion | Indel and HR | Knock-out & Knock-in |
| 19 Cas9-TdT | TdT | Human (homo sipens) | Terminal deoxyribonucleotidyl transferase | DSB, dsDNA/ssDNA | insertion of dNTP | Indel, labeling DSB with BrdU and subsequent sequencing to detect off target effect | Knock-out & Knock-in, Off-target detection |
| Cpf1 series | | | | | | | |
| 20 Cpf1-prok | | Francisella novicida U112 | | dsDNA | Double strand break | Control | Knock-out & Knock-in |
| 21 Cpf1-BPNLS | BPNLS | Francisella novicida U112 | Nuclear localization signal | dsDNA | Double strand break | Control | Knock-out & Knock-in |
| 22 Cpf1-RecJ | RecJ | Escherichia coli | 5'→3' exonuclease | ssDNA | blunt end/ 5' and 3' overhang | Removes 5' overhang generated by Cpf1 action, Indel and HR | Knock-out & Knock-in |
| 23 Cpf1-RecE | RecE | Escherichia coli | 5'→3' exonuclease | dsDNA | 3' overhang | Indel and HR | Knock-out & Knock-in |
| 24 Cpf1-T5Exo | T5Exo | Bacteriophage T5 | 5'→3' exonuclease | dsDNA and ssDNA | 3' overhang | Indel and HR | Knock-out & Knock-in |
| 25 Cpf1-Munabean | Mungbean | Vigna radiata | Single strand DNA digestion | ssDNA | blunt end | Indel and HR | Knock-out & Knock-in |
| 26 Cpf1-SF | Small fragment of DNAPolI | Escherichia coli | 5'→3' exo, 5' flap removal | dsDNA/5' overhang | overhang | Indel and HR | Knock-out & Knock-in |
| 27 Cpf1-DSB | DSB | Bacteriophage T4 | Double strand DNA binding protein after Cpf1 | dsDNA | insertion | Indel/HR by delivering the repair DNA bound to DSB | Knock-out & Knock-in |
| 28 DSB-Cpf1 | DSB | Bacteriophage T4 | Double strand DNA binding protein before Cpf1 | dsDNA | insertion | Indel/HR by delivering the repair DNA bound to DSB | Knock-out & Knock-in |
| 29 Cpf1-SSB | SSB | Escherichia coli | Single strand DNA binding protein after Cpf1 | ssDNA | insertion | Indel/HR by delivering oligodeoxyribonucleotides bound to SSB | Knock-out & Knock-in |
| 30 SSB-Cpf1 | SSB | Escherichia coli | Single strand DNA binding protein before Cpf1 | ssDNA | insertion | Indel/HR by delivering oligodeoxyribonucleotides bound to SSB | Knock-out & Knock-in |
| 31 SSB-Cpf1-RecJ | SSB + RecJ | Single strand DNA binding protein +5'→3' exonuclease | Single strand DNA binding protein +5'→3' exonuclease | ssDNA/dsDNA | insertion | Indel/HR by delivering oligodeoxynbonucleotides bound to SSB | Knock-out & Knock-in |
| 32 DSB-Cpf1-RecJ | DSB + RecJ | | Double strand DNA binding protein +5'→3' exonuclease | dsDNA/ssDNA | insertion | Indel/HR by delivering the repair DNA bound to DSB | Knock-out & Knock-in |
| 33 Cpf1-TdT | TdT | | Terminal deoxyribonucleotidyl transferase | DSB, dsDNA/ssDNA | insertion with BrdU | Indel, Labeling DSB with BrdU and subsequent sequencing to detect off target effect | Knock-out & Knock-in, Off-target detection |
| 34 Cpf1-Pol I | PolI | | Filling from 3' end | DSB | insertion | Indel/HRby enhancing polymerise activity | Knock-out & Knock-in |

As used herein, in some cases, a polypeptide domain corresponds to a named domain when consecutive residues comprising at least 70% of the named domain align to the claimed polypeptide so as to exhibit at least 70% identity. Alternatively, in some cases, a polypeptide domain corresponds to a named domain when consecutive residues comprising at least 70%, 75%, 80%, 85%, 90%, 95%, or 99% of the named domain align to the claimed polypeptide so as to exhibit at least 70%, 75%, 80%, 85%, 90%, 95%, or 99% identity. Alternately or in combination, a polypeptide domain corresponds to a named domain when at least 20 consecutive residues comprising of the named domain align to the claimed polypeptide so as to exhibit 100% identity across the at least 20 consecutive residues. Alternately, in some cases, a polypeptide domain corresponds to a named domain when at least 20, 25, 30, 35, 40, 50, 60, 70, 80, 90, or 100 consecutive residues comprising of the named domain align to the claimed polypeptide so as to exhibit 100% identity across the at least 20, 25, 30, 35, 40, 50, 60, 70, 80, 90, or 100 consecutive residues.

Sequence identity, such as for the purpose of assessing percent identity between one or more sequences, is measured by any suitable alignment algorithm, including but not limited to the Needleman-Wunsch algorithm, the BLAST algorithm, or the Smith-Waterman algorithm. Optimal alignment can be assessed using any suitable parameters of a chosen algorithm, including default parameters.

In some cases, a chimeric polypeptide does not have an animal glycosylation pattern. Alternatively or in combination, a chimeric polypeptide does not have a bacterial glycosylation pattern. Alternatively or in combination, a chimeric polypeptide does not have a fungal glycosylation pattern.

In some cases, a chimeric polypeptide is substantially free of bacterial cellular contaminant. For example, a chimeric polypeptide expressed, isolated and purified from a bacterial cell.

The chimeric polypeptides of the present disclosure include chimeric genes wherein any DME disclosed herein is translated in frame with Cas9. Importantly, the chimeric polypeptides disclosed herein can enhance the HR repair rate. In some embodiments, a 3' to 5' exonuclease can be fused to CRISPR Cas enzymes. In other cases a 5' to 3' exonuclease can be fused to CRISPR Cas enzymes. In some embodiments, the present disclose fusions of all of the above described exonucleases to a CRISPR Cas enzyme. In particular embodiments, exonuclease VIII (RecE) of *E. coli* was active preferentially on dsDNA blunt ends, which were usually produced by CRISPR/Cas9 enzyme. RecE is highly processive, degrading the 5' strand dsDNA to mononucleotides. We expect that Cas9-RecE will trigger changing a main route from error-free to error-prone in NHEJ repair process, then all DSBs by CRISPR/Cas9 result in indel mutations, which cause frameshift in the coding region of a gene. All of the fusion constructs, or chimeric polypeptides, shown in FIG. 5 are disclosed herein. These figures shows fusions of several DMEs to CRISPR Cas enzymes, as disclosed herein. Notably, the chimeric polypeptides disclosed herein enhances functionality to a degree that reduces the costs and demanding skill set required to practice effective CRISPR Cas9 genome editing.

The apparent rates of mutations after the action of CRISPR genome editing tools are relatively low in vivo due to outperformance of error-free repair mechanisms. To enhance both the rate of indel mutation and HR recombination, genome editing tools were constructed by translational fusion of DNA modifying enzymes (DME), DNA binding protein (DBP), or terminal deoxyribonucleotidyl transferase (TdT) at either upstream or downstream of CRISPR genome editing enzymes. In one embodiment, a variant irreversibly deleted the DNA at the CRISPR enzyme-dependent double strand break sites in 5'->3' direction, and the resulting modified ends with 3'-OH overhang can better serve HR repairs in presence of repair template. Disclosed herein are constructs that display functional enhancement of the CRISPR-Cas enzymes. Among Cas9-DME series, Cas9-RecJ showed the best performance in knock-out (KO) and knock-in (KI) performance efficiency in HEK293 cells and plant protoplasts. Second, Cas9-GFP exhibited high performance not only tracing the Cas9 protein due to GFP fluorescence but only genome editing for KO and KI. Third, unexpectedly, most exonuclease-fused Cas9 or Cpf1 exhibited superior performance in KO and KI as compared to Cas9 or Cpf1 unfused. Fourth, DSB-Spy-Cas9 bound to double stranded DNA, the binding between DSB-SpCas9 and dsDNA increased KO and KI efficiencies much more than employing SpCa9 and dsDNA. Fifth, off-target effects in Cas9-RecJ embodied the similar efficiency to Cas9 off-targeting in whole genome sequencing and targeted deep sequencing. Last, zinc sulfate effectively quenched Cas9 activity in vitro and in vivo HEK293 cells. FIG. 74-FIG. 125 show said new genome editing fusion constructs, knock-out and knock-in efficiency and percent change in efficiency over a control.

In some embodiments, sequences of exemplary chimeric polypeptides, also referred to herein as "CRISPR PLUS", are shown in TABLE 7. In some embodiments, sequences of exemplary chimeric polypeptide have at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% sequence identity to any one of SEQ ID NO: 1-SEQ ID NO: 56.

Compositions and systems herein are often used in various methods relating to increased targeted mutagenesis. Through use of compositions disclosed herein, a locus selected for mutagenesis is targeted by a programmable endonuclease such as a guide-RNA directed endonuclease so as to introduce a double-stranded break at a target locus. A broad range of endonucleases are consistent with the methods herein, such as Cas9, Cas12 or other programmable DNA endonuclease enzymes. Exonuclease activity is conveyed by an exonuclease domain fused to the endonuclease domain according to any of the examples provided herein or otherwise as understood in the art. Fusion polypeptides are administered, often in combination with targeting nucleic acids such as guide RNA so as to provide a programmable targeting mechanism to a locus of interest. A target locus is observed to have an increased rate of mutagenesis relative to a rate observed upon administration to a comparable sample of an endonuclease lacking a fusion to an exonuclease domain as disclosed herein. Often, upon sequencing of some, a substantial portion, a majority or all of non-target regions of a sample, one sees an off-target mutagenesis rate that is comparable to that of a rate observed upon administration to a comparable sample of an endonuclease lacking a fusion to an exonuclease domain as disclosed herein. Off-target sequencing variously comprises sequencing less than 1%, up to 1%, up to 5%, up to 10%, up to 15%, up to 20%, up to 25%, up to 30%, up to 35%, up to 40%, up to 45%, up to 50%, up to 55%, up to 60%, up to 65%, up to 70%, up to 75%, up to 80%, up to 85%, up to 90%, up to 95%, up to 99%, or at least 99% of a sample genome. That is, through practice of methods or use of compositions as disclosed herein, one achieves increased targeted mutagenesis of a selected locus such as a locus bound by a guide RNA, while maintaining an off-target mutagenesis rate comparable to or in some cases less than that observed using unfused endonuclease compositions.

Some methods further comprise targeted termination of an endonuclease/exonuclease reaction, such as by changing an ion concentration of a reaction, for example through addition of a Zinc ion such as that found in Zinc sulfate, $ZnSO_4$. Often, targeted termination of a reaction is used to decrease off-target mutagenesis events that may arise after sufficient cleavage of a target locus has been achieved.

Disclosed herein are methods for increasing mutation rate, homologous recombination rate, or concurrently both, by contacting a target nucleic acid such as a chromosome to a chimeric polypeptide of the disclosure. In some cases, the chimeric polypeptide comprises a site-specific endonuclease that generates a cleavage site in the chromosome, and an accessory polypeptide such as a DME, DBP, TdT, or a combination thereof. In some cases, the chimeric polypeptide yields an exposed 3' OH overhang at the cleavage site of the chromosome.

In some cases, a chimeric polypeptide increases mutation rate by increasing the efficiency of error-prone NHEJ. FIG. 3 depicts an illustrative method to increase efficiency of error-prone NHEJ using the chimeric polypeptide Cas9-RecE, which comprises a RecE moiety fused to the C-terminus of Cas9. As shown in FIG. 3, Cas9 generates a double-stranded break in the target DNA. The RecE moiety then irreversibly resects the DNA at the double-stranded break from a 5' to 3' direction, which greatly decreases the possibility of error-free NHEJ process. Thus, the efficiency of error-prone NHEJ process is increased.

FIG. 4 depicts an illustrative method to increase homologous recombination efficiency using a chimeric polypeptide such as Cas9-RecE. As shown in FIG. 4, Cas9 generates a double-stranded break in the target DNA. The RecE moiety then irreversibly resects the DNA at the double-stranded break from a 5' to 3' direction and generates a 3' single-stranded DNA overhang. The 3' single stranded overhang effectively attacks and hybridizes with homologous DNA, which can be in single-stranded form or double-stranded form as shown in FIG. 4. This results in an increase in the overall efficiency of HR as compared with that achieved with a Cas9 polypeptide lacking the RecE fusion moiety. In some cases, the efficiency of HR is increased by at least 10-fold.

The disclosure provides methods to decrease off-target cleavage and modification by site-specific endonucleases, for example, by treating the site-specific endonuclease with a metal ion such as Zn. In an exemplary method, a target nucleic acid is contacted with a chimeric polypeptide comprising a site-specific endonuclease such as Cas9. Once target modification is achieved, $ZnSO_4$ is added to abolish activity of Cas9, thereby preventing or reducing off-target effects of the site-specific endonuclease.

The disclosure provides methods for detecting off-target cleavage sites, for example, by tagging a cleavage site of a site-specific endonuclease. In an exemplary method, a target nucleic acid such as a chromosome is contacted with a labeled nucleic acid and a chimeric polypeptide comprising site-specific endonuclease activity and TdT activity. The TdT labels the cleavage sites of the site-specific endonuclease with the labeled nucleic acid. A labeled nucleic acid can comprise a non-canonical base such as BrdU. Non-limiting examples of non-canonical bases suitable for use with the disclosure include fluorescently labeled dNTP. The TdT adds the labeled nucleic acid at double-strand breaks generated by the site-specific endonuclease. The labeled nucleic acids are isolated and sequenced to determine off-target sites of the site-specific endonuclease.

The disclosure provides methods for increasing mutation efficiency of a site-specific endonuclease. In some cases, the mutation comprises one or more deletions. Alternatively, or in combination, the mutation comprises one or more insertions. In some cases, the mutation efficiency of a site-specific endonuclease is increased by at least about 1.1 fold, at least about 1.2 fold, at least about 1.3 fold, at least about 1.4 fold, at least about 1.5 fold, at least about 1.6 fold, at least about 1.7 fold, at least about 1.8 fold, at least about 1.9 fold, at least about 2 fold, at least about 2.5 fold, at least about 3 fold, at least about 3.5 fold, at least about 4 fold, at least about 4.5 fold, at least about 5 fold, at least about 6 fold, at least about 7 fold, at least about 8 fold, at least about 9 fold, at least about 10 fold, at least about 12 fold, at least about 15 fold, at least about 20-fold, at least about 50-fold, at least about 70-fold, or at least about 100-fold compared with that achieved with a wild-type site-specific endonuclease lacking the accessory polypeptide.

The disclosure provides methods for increasing homologous recombination efficiency of a site-specific endonuclease. In some cases, the homologous recombination efficiency of a site-specific endonuclease is increased by at least about 1.1 fold, at least about 1.2 fold, at least about 1.3 fold, at least about 1.4 fold, at least about 1.5 fold, at least about 1.6 fold, at least about 1.7 fold, at least about 1.8 fold, at least about 1.9 fold, at least about 2 fold, at least about 2.5 fold, at least about 3 fold, at least about 3.5 fold, at least about 4 fold, at least about 4.5 fold, at least about 5 fold, at least about 6 fold, at least about 7 fold, at least about 8 fold, at least about 9 fold, at least about 10 fold, at least about 12 fold, at least about 15 fold, at least about 20-fold, at least about 50-fold, at least about 70-fold, or at least about 100-fold compared with that achieved with a wild-type site-specific endonuclease lacking the accessory polypeptide.

The disclosure provides methods for increasing error-prone NHEJ in cells. In some cases, the error-prone NHEJ is increased by at least about: 10%, 20%, 30%, 40%, 50%, 60%, 70%, 80%, 90%, or 99% compared with that achieved with a wild-type site-specific endonuclease lacking an accessory polypeptide.

The disclosure provides methods for decreasing error-free NHEJ in cells. In some cases, the error-free NHEJ is decreased by at least about: 10%, 20%, 30%, 40%, 50%, 60%, 70%, 80%, 90%, or 99% compared with that achieved with a wild-type site-specific endonuclease lacking an accessory polypeptide.

Disclosed herein are chimeric polypeptides of CRISPR Cas enzymes and DMEs (e.g., any one of RecE, RecJ, lambda, mungbean nuclease, T5, TdT, SSB, DSB, GFP, or any other DME), wherein the knock-in efficiency, as measured by % HDR, is 1 to 10%, 10 to 20%, 20 to 30%, 30 to 40%, 40 to 50%, 50 to 60%, 60 to 70%, 70 to 80%, 80 to 90%, 90 to 100%, 1 to 20%, 20 to 40%, 40 to 60%, 60 to 80%, 80 to 100%, 5 to 15%, 15 to 25%, 25 to 35%, 35 to 45%, 45 to 55%, 55 to 65%, 65 to 75%, 1%, 2%, 3%, 4%, 5%, 6%, 7%, 8%, 9%, 10%, 15%, 20%, 30%, 40%, 50%, 60%, or 70%.

Some chimeric polypeptides of the present disclosure (e.g., any CRIPSR Cas enzyme fused to a DME (e.g., any one of RecE, RecJ, lambda, mungbean nuclease, T5, TdT, SSB, DSB, GFP, or any other DME)) displays a knock-in efficiency that is 1 to 10%, 10 to 20%, 20 to 30%, 30 to 40%, 40 to 50%, 50 to 60%, 60 to 70%, 70 to 80%, 80 to 90%, 90 to 100%, 1 to 20%, 20 to 40%, 40 to 60%, 60 to 80%, 80 to 100%, 5 to 15%, 15 to 25%, 25 to 35%, 35 to 45%, 45 to 55%, 55 to 65%, 65 to 75%, 1%, 2%, 3%, 4%, 5%, 6%, 7%, 8%, 9%, 10%, 15%, 20%, 30%, 40%, 50%, 60%, or 70% higher than a standard CRISPR Cas enzyme.

Some chimeric polypeptides of the present disclosure (e.g., any CRIPSR Cas enzyme fused to a DME (e.g., any one of RecE, RecJ, lambda, mungbean nuclease, T5, TdT, SSB, DSB, GFP, or any other DME)) displays a knock-in efficiency that is 2 to 10 fold, 10 to 20 fold, 20 to 30 fold, 30 to 40 fold, 40 to 50 fold, 50 to 60 fold, 60 to 70 fold, 70 to 80 fold, 80 to 90 fold, 90 to 100 fold, 2 to 20 fold, 20 to 40 fold, 40 to 60 fold, 60 to 80 fold, 80 to 100 fold, 5 to 15 fold, 15 to 25 fold, 25 to 35 fold, 35 to 45 fold, 45 to 55 fold, 55 to 65 fold, 65 to 75 fold, 2 fold, 3 fold, 4 fold, 5 fold, 6 fold, 7 fold, 8 fold, 9 fold, 10 fold, 15 fold, 20 fold, 30 fold, 40 fold, 50 fold, 60 fold, or 70 fold higher than a standard CRISPR Cas enzyme.

Also disclosed herein are chimeric polypeptides of CRISPR Cas enzymes and DMEs (e.g., any one of RecE, RecJ, lambda, mungbean nuclease, T5, TdT, SSB, DSB, GFP, or any other DME), wherein the knock-out efficiency, as measured by % indels, is 1 to 10%, 10 to 20%, 20 to 30%, 30 to 40%, 40 to 50%, 50 to 60%, 60 to 70%, 70 to 80%, 80 to 90%, 90 to 100%, 1 to 20%, 20 to 40%, 40 to 60%, 60 to 80%, 80 to 100%, 5 to 15%, 15 to 25%, 25 to 35%, 35 to 45%, 45 to 55%, 55 to 65%, 65 to 75%, 1%, 2%, 3%, 4%, 5%, 6%, 7%, 8%, 9%, 10%, 15%, 20%, 30%, 40%, 50%, 60%, or 70%.

Some chimeric polypeptides of the present disclosure (e.g., any CRIPSR Cas enzyme fused to a DME (e.g., any one of RecE, RecJ, lambda, mungbean nuclease, T5, TdT, SSB, DSB, GFP, or any other DME)) displays a knock-out efficiency that is 1 to 10%, 10 to 20%, 20 to 30%, 30 to 40%, 40 to 50%, 50 to 60%, 60 to 70%, 70 to 80%, 80 to 90%, 90 to 100%, 1 to 20%, 20 to 40%, 40 to 60%, 60 to 80%, 80 to 100%, 5 to 15%, 15 to 25%, 25 to 35%, 35 to 45%, 45 to 55%, 55 to 65%, 65 to 75%, 1%, 2%, 3%, 4%, 5%, 6%, 7%, 8%, 9%, 10%, 15%, 20%, 30%, 40%, 50%, 60%, or 70% higher than a standard CRISPR Cas enzyme.

The chimeric polypeptides of the present disclosure (e.g., any CRIPSR Cas enzyme fused to a DME (e.g., any one of RecE, RecJ, lambda, mungbean nuclease, T5, TdT, SSB, DSB, GFP, or any other DME)) displays a knock-out efficiency that is 2 to 10 fold, 10 to 20 fold, 20 to 30 fold, 30 to 40 fold, 40 to 50 fold, 50 to 60 fold, 60 to 70 fold, 70 to 80 fold, 80 to 90 fold, 90 to 100 fold, 2 to 20 fold, 20 to 40 fold, 40 to 60 fold, 60 to 80 fold, 80 to 100 fold, 5 to 15 fold, 15 to 25 fold, 25 to 35 fold, 35 to 45 fold, 45 to 55 fold, 55 to 65 fold, 65 to 75 fold, 2 fold, 3 fold, 4 fold, 5 fold, 6 fold, 7 fold, 8 fold, 9 fold, 10 fold, 15 fold, 20 fold, 30 fold, 40 fold, 50 fold, 60 fold, or 70 fold higher than a standard CRISPR Cas enzyme.

The above described improvements in on-target mutagenesis for the chimeric polypeptides of the present disclosure (e.g., any CRIPSR Cas enzyme fused to a DME (e.g., any one of RecE, RecJ, lambda, mungbean nuclease, T5, TdT, SSB, DSB, GFP, or any other DME)) are further coupled to decreased or dissimilar rates of mutagenesis at off-target sites as compared to a standard CRISPR Cas enzyme.

Activity of any of the chimeric polypeptides described herein (e.g., any CRIPSR Cas enzyme fused to a DME (e.g., any one of RecE, RecJ, lambda, mungbean nuclease, T5, TdT, SSB, DSB, GFP, or any other DME)) can be abolished or halted by addition of zinc sulfate. Zinc sulfate can be added in vitro or in vivo to halt genome editing. Zinc sulfate ($ZnSO_4$) can be added to halt activity of a chimeric polypeptide of the present disclosure at a concentration of up to 1 mM, up to 0.5 mM, up to 0.25 mM, up to 0.125 mM, up to 0.0625 mM, up to 31.3 nM, up to 15.6 nM, up to 7.8 nM, up to 3.9 nM, up to 2.0 nM, up to 1.0 nM, up to 0.5 nM, up to 0.2 nM, or up to 0.1 nM. Addition of zinc sulfate rapidly halts or decreases activity of the chimeric polypeptides disclosed herein (e.g., any CRIPSR Cas enzyme fused to a DME (e.g., any one of RecE, RecJ, lambda, mungbean nuclease, T5, TdT, SSB, DSB, GFP, or any other DME)). For example, zinc sulfate can inactivate said chimeric polypeptides in under 30 min, under 25 min, under 20 min, under 15 min, under 10 min, under 5 min, under 0 min, under 5 min, under 4 min, under 3 min, under 2 min, under 1 min, under 30 sec, under 25 sec, under 20 sec, under 15 sec, under 10 sec, or under 5 sec.

The disclosure provides methods to increase genome modification rate of a target nucleic acid by a site-specific endonuclease. In some cases, the genome modification rate exhibited by a chimeric polypeptide of the disclosure for a target nucleic acid is at least about 10%, 20%, 30%, 40%, 50%, 60%, 70%, 80%, 90%, or 99%.

The disclosure provides methods to decrease off-target effects of site-specific endonucleases. In some cases, the off-target effects are reduced by at least 10%, 20%, 30%, 40%, 50%, 60%, 70%, 80%, 90%, or 99% using the methods of the disclosure.

In some cases, a chimeric polypeptide of the disclosure is introduced into a cell as a nucleic acid encoding the chimeric polypeptide of the disclosure. Alternatively, a chimeric polypeptide is introduced into a cell as an mRNA transcript. Alternatively, a chimeric polypeptide is introduced into a cell as a polypeptide. Alternatively, a chimeric polypeptide is introduced into a cell or a protoplast as a ribonucleoprotein complex comprising the chimeric polypeptide and a guide nucleic acid.

In some cases, a chimeric polypeptide is introduced into a cell as a nucleic acid, for example, as a delivery vector, that encodes the chimeric polypeptide. Optionally, the nucleic acid comprises a promoter sequence for regulating expression of the chimeric polypeptide in the cell. Non-limiting examples of promoter sequences suitable for use with the disclosure include plant viral promoters, 35S promoter, rbcS promoter, psbA promoter, and ubiquitin promoter.

FIG. 5 shows illustrative nucleic acids encoding chimeric polypeptides of the disclosure. In FIG. 5, arrows with T7 annotation indicate promoter DNA sequence cognitive to T7 RNA polymerase. Boxes with different colors denote functional moieties such as HIS, the SV40 NLS, the BPNLS, RecJ, mungbean nuclease, T5, RecE, RecJ, SSB and/or DSB sites, and GFP fused upstream or downstream of the Cas9 effector protein.

The open reading frame of nucleic acids encoding chimeric polypeptides of the disclosure are in some cases at least partially codon-optimized for expression in a target organism or cell. Alternatively, the open reading frame of nucleic acids encoding chimeric polypeptides of the disclosure are in some cases fully codon-optimized for expression in a target organism or cell.

A nucleic acid encoding a chimeric polypeptide comprises a 5' UTR in some cases. Alternatively, or in combination, a nucleic acid encoding a chimeric polypeptide comprises a 3' UTR. The 5' UTR, 3' UTR, or both are in some cases at least partially codon-optimized for expression in a target organism or cell. Alternatively, the 5' UTR, 3' UTR, or both are in some cases fully codon-optimized for expression in a target organism or cell.

In some cases, a nucleic acid encoding a chimeric polypeptide of the disclosure is configured for transient expression in a target cell such as a plant cell. Alternatively, a nucleic acid encoding a chimeric polypeptide is configured for stable expression in a target cell. Alternatively, or in combination, a nucleic acid encoding a chimeric polypeptide is configured for *Agrobacterium* expression.

In some cases, delivery of a nucleic acid encoding a chimeric polypeptide into a cell is facilitated by coating the nucleic acid on a particle such as a gold particle or a tungsten particle. Non-limiting examples of delivery or transformation methods suitable for use with the disclosure include, for example, viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, and nanoparticle-mediated nucleic acid delivery.

In some cases, a nucleic acid encoding a chimeric polypeptide is packaged into a vector for delivery into a target cell. Non-limiting examples of vectors suitable for use with the disclosure include expression vectors such as viral and non-viral expression vectors, and transformation vectors such as bacterial transformation vectors, viral transformation vectors, transformation vectors for nuclear transformation, and transformation vectors for organellar transformation.

In some cases, a nucleic acid encoding a chimeric polypeptide additionally comprises a sequence encoding a guide nucleic acid such as guide RNA. In some cases, a nucleic acid encoding a chimeric polypeptide additionally comprises a sequence encoding a donor nucleic acid suitable for use a template for HR.

In some cases, the target organism or cell is a plant. Alternatively, a target organism or cell is a bacterium. Alternatively, a target organism or cell is an animal. Alternatively, a target organism or cell is a mammal. Alternatively, a target organism or cell is a human. Non-limiting examples of target organisms or cells suitable for use with the disclosure include a prokaryotic cell; a eukaryotic cell; a bacterial cell; an archaeal cell; a cell of a single-cell eukaryotic organism; a protozoa cell; a cell from a plant; an algal cell; seaweeds such as kelp; a fungal cell such as a yeast cell or a cell from a mushroom; an animal cell; a cell from an invertebrate animal such as fruit fly, cnidarian, echinoderm, and nematode; a cell from a vertebrate animal such as fish, amphibian, reptile, bird, and mammal; and a cell from a mammal such as a pig, a cow, a goat, a sheep, a rodent, a rat, a mouse, a non-human primate, and a human.

Non-limiting examples of plant cell types suitable for use with the disclosure include seeds, suspension cultures, embryos, meristematic regions, callus tissue, leaves, roots, shoots, gametophytes, sporophytes, pollen, and microspores. Non-limiting examples of plants suitable for use with the disclosure include monocots, dicots, crop plants, ornamental plants, non-domesticated plants, and wild plants.

Methods of the disclosure are performed at any suitable pH. A chimeric polypeptide of the disclosure is active and suitable for use at various pHs, including for example, pH 6, 7, 8, 9, and 10. As shown in FIG. 17, a pH scanning of the site-specific endonuclease SpCas9 showed that it is active at pH 6, 7, 8, 9, and 10.

Methods of the disclosure are performed for any suitable length of time needed to achieve the desired degree of nucleic acid modification. For example, a chimeric polypeptide of the disclosure can be contacted or incubated with a target nucleic acid for at least 1 hour, 2 hours, 5 hours, 10 hours, 20 hours or 50 hours. In some cases, a chimeric polypeptide is incubated with a target nucleic acid for 2 hours. Alternatively, a chimeric polypeptide is incubated with a target nucleic acid for 20 hours.

Shown in FIG. 5 are schematics of nucleic acid constructs encoding chimeric polypeptides to enhance Cas9 function. The legend on the right of the diagram illustrates the various elements or features that may be present in the nucleic acid constructs. Examples of nucleic acid constructs are shown on the left. Examples of elements or features include HIS that is present 5' of SpCas9 in all constructs shown. A further element or feature is the SV40NLS that may be present 3' of SpCas9, as shown in the first, ninth, and tenth construct from the top. As another example, a BPNLS may be present 3' of SpCas9, as shown in third to eighth and eleventh to fourteenth constructs shown from the top. An SSB may be present, as illustrated in the eighth, ninth, and fourteenth construct shown from the top. The SSB may be 5' of SpCas9. A DSB may be present 5' of SpCas9, as shown in the tenth and eleventh construct from the top. Additional elements or features include RecJ, mungbean nuclease T5, RecE, RecJ and GFP, as shown in the legend and constructs by the various sized rectangles. The position of the elements or features is not limited by the position shown in FIG. 5, i.e. any element or feature may be located either upstream or downstream of SpCas9.

As shown in FIG. 8A that shows the sequences of PCR products of dsDNA following treatment with SpCas9 for 1 h followed by treatment with mungbean nuclease, treatment resulted in a six-nucleotide deletion in one of 32 sequences. FIG. 8B shows that treatment with SpCas9-RecE resulted in deletion in four of 32 sequences, thus representing a 400-fold increase compared to treatment with SpCas9.

FIG. 9A shows alignment of PCR product sequences generated by treating dsDNA with SpCas9 for 3 h followed by mungbean exonuclease treatment. 72 out of 80 sequences shown comprised deletions. FIG. 9B shows alignment of PCR product sequences generated by treating dsDNA with SpCas9-RecE for 3 h followed by mungbean exonuclease treatment. 68 out of 80 sequences shown comprised deletions.

FIG. 10 shows alignment of PCR product sequences generated by treating dsDNA with SpCas9 and T4 DNA polymerase (top panel), and SpCas9-RecE and T4 DNA polymerase (lower panel). For SpCas9, an average 6-nt deletion was detected. For SpCas9-RecE, approximately 20-nt deletion sequences were detected. All sequences shown in FIG. 10 comprised deletions near or encompassing an XcmI restriction site.

FIG. 16 illustrates alignment of PCR product sequences generated by treating dsDNA with SpCas9 and Q5 DNA polymerase (top panel), and SpCas9-T5 exonuclease and Q5 DNA polymerase (bottom panel). For SpCas9, no deletion was detected. For SpCas9-T5 Exo, one 1-nt, one 2-nt, and one 19-nt deletions were detected, as shown for the sequences illustrated in FIG. 16. Gel electrophoresis results shown in FIG. 16 correspond to those of FIG. 15 that illustrates cleavage of circular dsDNA by SpCas9 and SpCas9-T5 exonuclease. The NcoI site is indicated at the top of the sequence shown in FIG. 16 as indicated by the square and arrow.

FIG. 1 demonstrates NHEJ repair in response to a double strand break. From top to bottom the figure illustrates an sg-RNA-Cas9 complex bound to a nucleic acid, adjacent to a PAM, inducing a double stranded break (DSB). NHEJ repairs can be error prone, leading to insertions (as shown in the circled, inserted A residue) or can lead to deletions (as shown in the circled region shown periods for deleted residues). Error-free repair is shown at the bottom.

FIG. 2 illustrates a schematic of CRISPR systems of the present invention which can include a TAG (at the N- or C-terminus), for example a purification tag like 6×HIS (SEQ ID NO: 78), an NLS (nuclear localization signal, at the N- or C-terminus), DME (DNA modifying enzyme), DBP (DNA binding protein), or TdT (deoxyribonucleotidyl transferase) fused in frame with N- or C-terminus of a gene editing (GE) effector protein, followed by Cas9 or Cpf1 (CRISPR genome editing effector proteins).

FIG. 3 shows from top to bottom a composition of the present disclosure comprising a Cas9 fused to a RecE exonuclease. This entire construct induces a double-stranded break (DSB) followed by RecE exonuclease activity. This figure demonstrates how to increase the efficiency of error-prone NHEJ using novel Cas9-RecE recombinant enzyme.

Due to RecE moiety fused to the C-terminus of Cas9 protein, the DNAs at DSB are irreversibly resected from 5' to 3' direction, which greatly decrease the possibility of error-free NHEJ process FIG. 4 shows from top to bottom a composition of the present disclosure comprising a Cas9 fused to a RecE exonuclease. This entire construct induces a double-stranded break (DSB) followed by RecE exonuclease activity. Subsequently a single stranded DNA oligonucleotide (ssODNs) and circular double stranded DNA (dsDNA) is added leading to the intended replacement via HR systems. This figure demonstrates how to increase the homologous recombination efficiency using 3' overhang DNA generated by RecE activity. Due to RecE activity, single strand DNA stretch with 3' overhang is generated. This single strand DNA stretch can effectively attack homologous DNA with either single strand or double strand forms. Overall efficiency of HR is greatly increased as high as 10-folds FIG. 5 illustrates from top to bottom Cas9 fusion constructs of the present disclosure. At top is shown a construct having HIS, SpCas9, and SV40NL. Below that is a construct having HIS and SpCas9. Below that is a construct having HIS, SpCas9, and BPNLS. Below that is a construct having HIS, SpCas9, RecJ, and BPNLS. Below that is a construct having HIS, SpCas9, mungbean nuclease, and BPNLS. Below that is a construct having HIS, SpCas9, T5, and BPNLS. Below that is a construct having HIS, SpCas9, RecE, and BPNLS. Below that is a construct having HIS, SSB, SpCas9, RecJ, and BPNLS. Below that is a construct having HIS, SSB, SpCas9, and SV40NLS. Below that is a construct having HIS, DSB, SpCas9, and SV40NLS. Below that is a construct having HIS, DSB, SpCas9, and BPNLS. Below that is a construct having HIS, SpCas9, GFP, and BPNLS. Below that is a construct having HIS, GFP, SpCas9, and BPNLS. Below that is a construct having HIS, SSB, SpCas9, RecE, and BPNLS.

FIG. 6 illustrates a gel showing from left to right lanes of mock, SpCas9, SpCas9-RecE v1, SpCas9-RecE v2, DNA marker (ladder), mock, SpCas9, SpCas9-RecE v1, and SpCas9-RecE v2. The left half of the gel shows linear dsDNA A and the right half of the gel shows linear dsDNA B. 514 bp, 328 bp, and 186 bp as marked at the left hand side of the gel indicate where products resolve. 317 bp, 170 bp, and 147 bp, as marked at the right hand side of the gel, indicate where products resolve. To the right is a schematic of the linear dsDNA (514 bp) and the expected fragments of 186 bp and 328 bp and linear dsDNA B (317 bp) and the expected fragments of 170 bp and 147 bp.

FIG. 7 also illustrates cleaving by the constructs disclosed herein. The lanes from left to right include a ladder followed by three lanes showing gRNA C+, pGEM-C_447 bp (3,447 bp)+ with SpCas9 followed by three lanes showing gRNA C+, pGEM-C_447 bp (3,447 bp)+ with SpCas9-RecE, followed by a final column with no nuclease and gRNA C−, pGEM-C_447 bp (3,447 bp)+. The position of 3,447 bp, nicked is shown at the right, followed by 3,447 bp relaxed circular product, followed by 3,447 bp linear.

FIG. 8A illustrates 1 in 32 deletions after gene editing with SpCas9. The single six nucleotide deletion is circled. FIG. 8B illustrates 4 in 32 deletions after gene editing with SpCas9-RecE, including one three-nt deletion, one six-nt deletion, and two fifteen nt deletions, each of which is circled. FIGS. 8A and 8B shows alignment of PCR product sequences. SpCas9 was treated for 1 h, The cleaved dsDNAs were subjected to mungbean exonuclease treatment, then, the cleaved dsDNAs were subjected to DNA for 40 min. The single linear DNA sizes were eluted, cleaned-up, and ligated their own linear dsDNA, then read the cleavage site of 32 colonies by SpCas9. One 6-nt deletion was detected. SpCas9-RecE was treated for 1 h, The cleaved dsDNAs were subjected to mungbean exonuclease treatment, then, the cleaved dsDNAs were subjected to DNA for 40 min. The single linear DNA sizes were eluted, cleaned-up, and ligated their own linear dsDNA, then read the cleavage site of 32 colonies by SpCas9-RecE. One 3-nt, one 6-nt, and two 15-nt deletion sequences were detected.

FIG. 9A shows 72/80 deletions after gene editing with SpCas9, all of which are together circled. FIG. 9B shows 68/80 deletions after gene editing with SpCas9-RecE, all of which are together circled, FIGS. 9A and 9B shows alignment of PCR product sequences. SpCas9 was treated for 3 h, the cleaved dsDNAs were subjected to mungbean exonuclease treatment, which removed flap structures of dsDNA. Then, the cleaved dsDNAs were subjected to DNA for 40 min. The single linear DNA sizes were eluted, cleaned-up, and ligated their own linear dsDNA, then read the cleavage site of 80 colonies by SpCas9. Average 8-nt deletion were detected in 72 colonies, which had edited sequences among 80 colonies. SpCas9-RecE was treated for 3 h, the cleaved dsDNAs were subjected to mungbean exonuclease treatment, then, the cleaved dsDNAs were subjected to DNA for 40 min. The single linear DNA sizes were eluted, cleaned-up, and ligated their own linear dsDNA, then read the cleavage site of 80 colonies by SpCas9-RecE. Approximately 17-nt deletion sequences were detected in 68 colonies, which had edited sequences among 80 colonies FIG. 10 shows deletions, which are circled after gene editing with SpCas9+T4DNA pol and SpCas9-RecE+T4 DNA pol, FIG. 10 shows alignment of PCR product sequences. SpCas9 was treated for 2 h, the cleaved dsDNAs were subjected to T4 DNA polymerase treatment, which filled up the single stranded DNA of dsDNA ends, then, the cleaved dsDNAs were subjected to DNA for 40 min. The single linear DNA sizes were eluted, cleaned-up, and ligated their own linear dsDNA, then read the cleavage site of 32 colonies by SpCas9. Average 6-nt deletion were detected. SpCas9-RecE was treated for 2 h, the cleaved dsDNAs were subjected to T4 DNA polymerase treatment, then they were subjected to DNA electrophoresis for 40 min. The single linear DNA sizes were eluted, cleaned-up, and ligated their own linear dsDNA, then read the cleavage site of 32 colonies by SpCas9-RecE. Approximately 20-nt deletion sequences were detected.

Shown in FIG. 11 is a graph, which on the y-axis shows the number of indels (bp) from 0 to 40 in increments of 5 and on the x-axis shows gene editing constructs tested including from left to right SpCas9 with mungbean exonuclease treatment, SpCas9-RecE with mungbean exonuclease treatment, SpCas9 with T4 DNA polymerase treatment, and SpCas9-RecE with T4 DNA polymerase treatment. SpCas9-RecE gene editing constructs increased the number of indels as compared to the corresponding SpCas9 alone controls. In the mungbean exonuclease treatment group significance was $p=1.8 \times 10^{-10}$ and in the T5 treatment group, significance was $p=0.6 \times 10^{-2}$. The box plot shows SpCas9 and SpCas9-RecE under mungbean exonuclease and T4 DNA polymerase treatment. The left panel was treated by mungbean treatment and the right panel was treated by T4 DNA polymerase. The difference between the edited lines and control non-edited lines was evaluated by Students's T test. Standard deviation (SD)s are provided.

As shown in the schematic of FIG. 12A, circular DNA can be treated with Cas9 or Cas9-RecE, followed by addition of Q5 polymerase and DNA electrophoresis, followed by *E. coli* transfection, colony by PCR (M13F/M13R) and XcmI treatment. FIG. 12B shows multiple gels, with lanes numbered sequentially for Cas9:BPNLS (top two gels) and Cas9-RecE (bottom two gels). FIG. 12A shows a schematic diagram for in vitro cleavage assay. SpCas9 was treated to circular dsDNAs for 3 h, the cleaved dsDNAs were subjected to Q5 DNA polymerase treatment, which filled up the single stranded DNA of dsDNA ends, then, the cleaved dsDNAs were subjected to DNA electrophoresis for 40 min. The single linear DNA sizes were eluted, cleaned-up, and ligated their own linear dsDNA, then the colonies were amplified with M13F/M13R primer pairs, which were used for sequencing the PCR products. The PCR products should be digested by XcmI when the amplified region was untouched by SpCas9s or repaired by Q5 polymerase. The PCR products were not digested by XcmI in 7 out of 30 colonies by SpCas9, while the cleavage site was not digested in 14 out of 27 colonies by SpCas9-RecE. The products by XcmI were incubated at 37° C. for 1 h. FIG. 12B shows DNA electrophoresis, blue arrows are uncut, cut1, and cut2 fragments by XcmI and red arrows are uncut colonies by XcmI.

FIG. 13 shows a gel comparing Cas9-BPNLS (166 kD) and Cas9-RecJ-BPNLS (230 kd). The used protein amount for Cas9-BPNLS is shown at the left from top to bottom as 0.2 ug, 0.4 ug, 0.8 ug, and 1.6 ug. All Cas9-BPNLS (5 at the left) are nuclease +, gRNA C+, and pGEM_C+. A ladder is shown in the middle lane of the gel. The used protein amount for Cas9-RecJ-BPNLS is shown at the right from top to bottom as 0.3 ug, 0.5 ug, 1.1 ug, and 2.1 ug. All Cas9-RecJ-BPNLS (5 at right) are clease +, gRNA C+, and pGEM_C+. Nicks and linear coiled products are shown in the top most row. Degraded products are shown in row 3 and row 4 of the gel. FIG. 13 shows an in vitro cleavage assay with circular dsDNA by Cas9 and Cas9-RecJ exonuclease. Plasmid dsDNA C was used for circular dsDNA templates, and a sgRNA C was used to guide Cas9 into target site before PAM. Linear dsDNA showed sharp and thick dsDNA size in DNA electrophoresis. After incubation, SpCas9/gRNA C apoproteins. SpCas9 produced single sharp and thick dsDNA sizes without time-dependency, while SpCas9-RecJ/gRNA C showed a blur, weak, think, and tailed dsDNA, which stand for DNA degradation after 60-180 minutes, FIG. 14 shows three gels from left to right which are Toolgen, In house Cas9, and In house Cas9-Rec J. The left most gel to the left of the three gels previously described is a ladder showing the 600 bp line and the 100 bp line. In the three gels, a time course is shown. Within the three gels the lanes are 0 h, 12 h, 24 h, and 48 h. Below the gels % indels, which is shown as 12.9% for the Toolgen gel under 48 h, as 21.6% for the In House Cas9 gel at 48 h, and as 28.3%, 35%, and 40.3% respectively for the 24 h, 48 h, and 72 h time points in the In House Cas9-RecJ gel. FIG. 14 shows time course of gene editing efficiency. Each Cas9 variant and the same guide RNA against the same loci of human DHCR7 complex was transfected to HEK293 cells using lipid mediated transfection method. Cells were harvested at different time points from 0 hours, as a control, to 72 hours, for genomic DNA extraction. In order to improve discriminability of cut DNA band, alternative PCR primer pairs were used and that resulted in clearer single band whose size is nearly 300 bp, which was the product of T7E1 endonuclease activity and therefore measured to compare % indels.

FIG. 15 shows a DNA ladder in the left most column. After the ladder from left to right, the groups shown include control, control, SpCas9-BPNLS, SpCas9-T5-BPNLS, SpCas9-BPNLS, SpCas9-T5-BPNLS, and NcoI. For the first lane after the ladder, nuclease is indicated as −, gRNA C is indicated as −, and pGEM-C_447 bp is indicated as +. For the second lane after the ladder, nuclease is indicated as −, gRNA C is indicated as +, and pGEM-C_447 bp is indicated as +. For SpCas9-BPNLS in the following lane, nuclease is indicated as +, gRNA C is indicated as −, and pGEM-C_447 bp is indicated as +. For SpCas9-T5-BPNLS in the following lane, nuclease is indicated as +, gRNA C is indicated as −, and pGEM-C_447 bp is indicated as +. For SpCas9-BPNLS, in the following lane nuclease is indicated as +, gRNA C is indicated as +, and pGEM-C_447 bp is indicated as +. For SpCas9-T5-BPNLS, in the following lane nuclease is indicated as +, gRNA C is indicated as +, and pGEM-C_447 bp is indicated as +. For NcoIn the following lane nuclease is indicated as +, gRNA C is indicated as +, and pGEM-C_447 bp is indicated as +. The figure shows DNA electrophoresis of circular dsDNA cleavage by SpCas9 and SpCas9-T5 exonuclease. Plasmid dsDNA C was used for circular dsDNA templates, and a sgRNA C was used to guide Cas9 into target site before PAM. Linear dsDNA mobility shifted slowly, which made it possible to show different size mobility between the same sized circular dsDNA and linear dsDNA. SpCas9 or SpCas9-T5 converted circular dsDNA to linear dsDNA by producing double stranded breaks on circular dsDNA. Arrows indicate different structure types of the same dsDNA.

FIG. 16 shows alignment of PCR product sequences. SpCas9 was treated for 3 h, the cleaved dsDNAs were subjected to Q5 DNA polymerase treatment, which filled up the single stranded DNA of dsDNA ends, then, the cleaved dsDNAs were subjected to DNA for 40 min. The single linear DNA sizes were eluted, cleaned-up, and ligated their own linear dsDNA, then read the cleavage site of 19 colonies by SpCas9. No deletion was detected. SpCas9-RecE was treated for 3 h, the cleaved dsDNAs were subjected to Q5 DNA polymerase treatment, then they were subjected to DNA electrophoresis for 40 min. The single linear DNA sizes were eluted, cleaned-up, and ligated their own linear dsDNA, then read the cleavage site of 19 colonies by SpCas9-RecE. One 1-nt, one 2-nt, and one 19-nt deletions were detected.

FIG. 17 shows a gel at top after treatment with SpCas9: BPNLS with 1 ug at 1 h or 3 hr. pH ranges tested included 3, 4, 5, 6, 7, 8, 9, and 10. At the 1 h timepoint, cut products were seen at pH 6, 7, 8, 9, 10 at percentages of 65, 80, 94, 97, and 100, respectively. At the 3 h timepoint, cut products were seen at pH 6, 7, 8, 9, 10 at percentages of 71, 91, 94, 96, and 100, respectively. Shown below the gels is a table summarizing the in vitro assay and amount of RGEN. For PCR dsDNA product, 150 ng was used; for SpCas9:BPNLS, 1 μg was used; for gRNA, 500 ng was used; for pH titration (50 mM potassium acetate and 20 mM tris-acetate, 10 mM magnesium acetate), 10 μl was used, for DW, up to 20 μl was used. Activity was observed up to pH 10. SpCas9 protein activity was scanned in pH range from pH3 to pH10. Its activity was shown from pH6 to pH10. The best performance of SpCas9 exhibited at pH10 for 1 h.

FIG. 18 shows a gel at top after treatment with Cas9: BPNLS or Cas9-mungbean-BPNLSat 1 hr or 3 hr. pH ranges tested included 3, 4, 5, 6, 7, 8, 9, and 10. Uncut and cut fragments are indicated by arrows at the right, Uncut resolves towards the top of the gel and cut 1 and cut 2 resolve towards the bottom of the gel. Shown below the gels is a table summarizing the in vitro assay and amount of RGEN. For DNA (50 ng) NbFTa13_4 PCR product, 3 μl (150 ng) was used; for SpCas9-BPNLS (3.3 μg) 1/10 dilution (333 ng), 1.5 µl (0.5 µg) was used; for gRNA (1.5 µg) (NbFTa13_3/4-2), 1/10 dilution (150 ng), 3.5 µg (500 ng) was used; for pH (+1 mM ZnSO4, 2× cutsmart), 10 µl was used; for DW, up to 20 µl was used. SpCas9 endonuclease activity was abolished when added 1 mM ZnSO4, which was competed against $Mg^{2+}$.

FIG. 19 shows a gel at top after treatment with SpCas9:BPNLS at 3 h either $Mg^{2+}$ free (top gel) or 1 mM ZnSO4 (bottom gel). pH ranges tested included 3, 4, 5, 6, 7, 8, 9, and 10. Cut products were seen at pH 6, 7, 8, 9, 10 at percentages of 2, 4, 3, 1, and 8, respectively. Shown below the gels is a table summarizing the in vitro assay and amount of RGEN. For PCR dsDNA product, 150 ng was used; for SpCas9:BPNLS, 1 µg was used; for gRNA, 500 ng was used; for pH titration (100 mM NaCal, 50 mM Tris-HCl+1 mM ZnSO4), 10 ul was used, for DW, up to 20 µl was used. Zn ion nearly replaced Mg ion, abolished Cas9 function, and was an effective inhibitor of Cas9 enzyme. Cas9 activity was tested in the presence of 1 mM ZnSO4 at a range of pH values and abolished Cas9 activity up to 90%. Under $Mg^{2+}$ deficiency, SpCas9 also lost its activity. When added 1 mM ZnSO4, SpCas9 activity was recovered less than 10% at pH10 for 1 h without Mg'.

FIG. 20A illustrates a gel. From left to right the lanes are ladder, Cas9 48 h, Cas9 RecJ 24 h, Cas9 RecJ 48 h, Cas9 48 h, Cas9 RecJ 24 h, Cas9 RecJ 48 h, Cas9 48 h, Cas9 RecJ 24 h, Cas9 RecJ 48 h, Cas9 48 h, Cas9 RecJ 24 h, and Cas9 RecJ 48 h, Presence or absence of CCR5, PD-1, and T7E1 is indicated under each lane with a + or −. CCR5, PD-1, and T7E1 were +, −, − for Cas9 48 h, +, −, − for Cas9 RecJ 24 h, +, −, − for Cas9 RecJ 48 h, −, +, − for Cas9 48 h, −, +, − for Cas9 RecJ 24 h, −, +, − for Cas9 RecJ 48 h, +, −, + for Cas9 48 h, +, −, + for Cas9 RecJ 24 h, +, −, + for Cas9 RecJ 48 h, −, +, +, for Cas9 48 h, −, +, +, for Cas9 RecJ 24 h, and −, +, +, for Cas9 RecJ 48 h. FIG. 20B illustrates a gel. From left to right, the lanes are the ladder, followed by 4 lanes for Cas9 RecJ 24 h for ADVY5, KCNJ6, CNTPNA1, and Chr.5, followed by 4 lanes for In house Cas9 48 h for ADVY5, KCNJ6, CNTPNA1, and Chr.5, and Cas9 RecJ 48 h for ADVY5, KCNJ6, CNTPNA1, and Chr.5. ADVY5 resolved at 641 bps, KCNJ6 resolved at 566 bps, CNTPNA1 resolved at 300 bps, and Chr.5 resolved at 605 bps. FIG. 20C shows off-target effects for CCR5, all are + for T7E1. From left to right, the lanes are the ladder, followed by 4 lanes for Cas9 RecJ 24 h for ADVY5, KCNJ6, CNTPNA1, and Chr.5, followed by 4 lanes for In house Cas9 48 h for ADVY5, KCNJ6, CNTPNA1, and Chr.5, and Cas9 RecJ 48 h for ADVY5, KCNJ6, CNTPNA1, and Chr.5. ADVY5 is indicated as 377+264, KCNJ6 is indicated as 352+214, CNTPNA1 is indicated as 183+117, and Chr.5 is indicated as 355+250. FIG. 20A-C illustrates in-vitro cleavage assay of SpCas9 and SpCas9-RecJ in HEK293 cells to test gene editing efficiency. FIG. 20A illustrates Cas9 and Cas9-RecJ apoproteins against the same loci of human PD-1 and CCR5 was transfected to HEK293 cells using lipid mediated transfection method. Cells were harvested at different time points, from 0 hours, as a control, to 48 hours, for genomic DNA extraction. PCR was performed to generate 544 bp for CCR5 and 524 bp for PD-1. T7E1 endonuclease assay allowed CCR5 produced two 274 and 271 bps small fragments, and PD-1 produced two 319 and 205 bps small fragments, which were used to measure indel efficiency. FIG. 20B illustrates amplification five off-targeting genes of human CCR5 sgRNA. ADCY5, 641 bps; KCNJ6, 566 bps; CNTPNA2, 300 bps; Chr.5, 605 bps. FIG. 20C illustrates in vitro cleavage assay with five off-targeted genes. Expected cut DNA sizes were 377 and 264 bps in ADCY5; 352 and 214 bps in KCNJ6; 183 and 117 bps in CNTPNA2; 355 and 250 bps in Ch. 5. Cleavage were not clear to verify off-targeting effect. Based on in-vitro assay, off-targeting of SpCas9-RecJ was not different with that of SpCas9.

FIG. 21 illustrates a gel of FnCpf1:BPNLS. From left to right the lanes are a ladder, PCR product, pH 3, pH 4, pH 5, pH 6, pH 7, pH 8, pH 9, pH 10. For lanes where pH was tested cut products are shown as a percentage at bottom as 0%, 0%, 0%, 92%, 95%, 76%, 43%, and 37%. On the right hand side, uncut product is shown with an arrow near the top of the gel and cut 1 and cut 2 are shown below. FIG. 21 shows FnCpf1 activity under different pH ranges. FnCpf1 protein activity was scanned in pH range from pH3 to pH10. Its activity was shown from pH6 to pH10. The best performance of FnCpf1 exhibited at pH7 for 1 h.

FIG. 22 illustrates a gel. From left to right, the lanes show a ladder; a control with linear dsDNA (1,197 bp), no sgRNA, and no nuclease; a control with linear dsDNA (1,197 bp), with sgRNA, and no nuclease; an FnCpf1 BPNLS with linear dsDNA (1,197 bp), with sgRNA, and with nuclease; an FnCpf1-RecJ-BPNLS with linear dsDNA (1,197 bp), with sgRNA, and with nuclease; GFP-FnCpf1-BPNLS with linear dsDNA (1,197 bp), with sgRNA, and with nuclease, a lane with linear dsDNA (1,197 bp), with sgRNA, and no nuclease; and an SpCas9-BPNLS with linear dsDNA (1,197 bp), with sgRNA, and with nuclease. The ladder on the left shows as a 1 kb marker—1,500 bp, 1000 bp, 750 bp, 500 bp, and 250 bp. The FnCpf1 BPNLS and FnCpf1-RecJ-BPNLS lanes show Cpf1-cut bands at 625 bp, 572 bp. In the FnCpf1-RecJ-BPNLS lane, a smearing similar to SpCas9-RecJ-BPNLS nuclease activity was observed. In SpCas9-BPNLS, Cas9 cut bands at 605 bp, and 592 bp were seen. FIG. 22 shows in vitro cleavage assay with linear dsDNA by FnCpf1, FnCpf1-RecJ, SpCas9 exonuclease. Linear dsDNA was amplified from plasmid via polymerase chain reaction and column purified. Cas9 sgRNA and Cpf1 sgRNA sites were adjacent to each other. The sgRNA was used to guide SpCas9 or FnCpf1 proteins to designated target sites that were located upstream of 5'-NGG-3' and downstream of 5'-TTTN-3' protospacer adjacent motif (PAM), respectively. The intact linear dsDNA before cut was clearly observed as a single band at around 1200 bp region. The band was cut into two 600 bp bands. However, with FnCpf1-RecJ, the cut bands were disappeared by the exonuclease activity of RecJ FIG. 23 illustrates FnCpf1-BPNLS (152 kDa) is shown in the left six lanes with time points of 0 min, 10 min, 30 min, 60 min, 120 min, and 180 min fro left to right. Cut products were respectively found to be 0, 10, 25, 43, 66, and 79% in the top gel and 0, 15, 36, 58, 86, and 94% in the bottom gel. The top gel shows 250 mM nuclease and 350 nM sgRNA. The bottom gel shows 500 nM nuclease and 700 nM sgRNA. The top bands in the gels show bands at 1200 bp. The bottom bands in the gels show bands at 600 bp. A DNA ladder is shown in center of the images. This is followed by the FnCpf1-RecJ-BPNLS (224 kDa) group with six lanes showing time points of 0 min, 10 min, 30 min, 60 min, 120 min, and 180 min fro, left to right. Cut products were respectively found to be 100, 71, 53, 43, 25, and 13% in the top gel and 100, 64, 50, 29, 4, and 9% in the bottom gel.

FIG. 23 illustrates In vitro cleavage assay with linear dsDNA by FnCpf1 or FnCpf1-RecJ exonuclease. Linear dsDNA was amplified from plasmid via polymerase chain reaction and column purified. The sgRNA was used to guide FnCpf1 proteins to designated target sites that were located downstream of 5nam of 5'-TTTN-3' protospacer adjacent motif (PAM), rt linear dsDNA before cut was clearly observed as a single band at around 1200 bp region. The band was designed to cut into two 600 bp bands. Along with the increment of the incubation period, the original bands were disappeared in both FnCpf1 and FnCpf1-RecJ reaction mixtures. However, with FnCpf1-RecJ, the cut bands were disappeared by the exonuclease activity of RecJ.

FIG. 24 shows at top functional genomics with random mutagenesis including T-DNA tagging methods. The schematic shows T-DNA random insertion in the genome, *Arabidopsis*, and *Agrobacterium* T-DNA. Shown below is a population containing T-DNA tag in every gene of *Arabidopsis* genome and forward genetics, reverse genetics, and sequencing the flanking DNA, which inform gene function. Shown at the bottom of the figure is a gene map of *Arabidopsis thaliana*.

FIG. 25 illustrates a schematic of the evolution of site-specific genome editing including ZFN, TALEN, and Cas9. At the top is a meganuclease having a target of 20-40 bp/enzyme. Below that is a ZFN having a target of 3 bp/finger. Below that is a TALEN having a target of 1 bp/module. Below that is a CRISPR-Cas having a target of 1 bp/base.

FIG. 26 illustrates shows a schematic of CRIPSR including a bacteriophage, a bacteria and various steps including spacer acquisition, crRNA processing, and interference.

FIG. 27 illustrates a schematic of types of CRISPR systems. At the very top is phage infection. In the first row is spacer acquisition and shown is a piece of nucleic acid having the generalized CRIPSR locus, Cas genes, a leader, a CRIPSR array, a spacer, and a direct repeat. The row below that is the crRNA biogenesis and processing, which shows from left to right, Type I leading to the cascade complex, Type IIx leading to the Cas9/sgRNA complex, and Type III leading to the Csm comple. Shown below that is target degradation, FIG. 28 illustrates advantages of RNP methods over DNA and RNA approaches including high editing efficiency, quick reaction, low off-targeting, no foreign DNA use, and simple multiplexing. At top, a graph shows percent indels on the y-axis from 0 to 100 in increments of 20. For each test on the x-axis, three bars are shown, which from left to right are protein DNA, and mRNA. At bottom, a graph shows off/on target ratio on the y-axis from 0 to 2 at 0.5 intervals. On the x-axis is OT3-2 and OT3-18 with each group showing 3 bars, which from left to right are DNA, RNA, and protein.

FIG. 29 shows a table of CRISPR/Cas9 delivery methods. For plasmid DNA, miRNA, and RNP, a number of metrics are ranked out of 4 "+" signs. For plasmid DNA, efficiency is +, off-target effects is ++++, economy is +++, difficulty is +, and multiplexing is ++. For miRNA, efficiency is ++, off-target effects is +++, economy is ++, difficulty is ++, and multiplexing is ++. For RNP, efficiency is ++++, off-target effects is +, economy is +, difficulty is ++++, and multiplexing is ++++

FIG. 30, at top left, shows chromatograms showing HiTrap Ni-chelating profile. At right, the figure shows 2 gels. In the top gel, lanes from left to right are a ladder, WT, Ni Elu, and Desalt Elu. In the bottom gel, the first two lanes are WT and Ni Elu. The right most lane is a DNA ladder. The DNA ladder at the top shows bands at kDa values of 245, 180, 135, 100, 75, 63, 48, 35, 25, 20, 17, and 11. The DNA ladder at the top shows bands at kDa values of 245, 180, 135, 100, 75, 63, 48, 35, 25, and 20. The figure at the bottom shows the instrument.

FIG. 31 illustrates procedures to prepare CRISPR enzymes, sgRNA preparation, and holoenzyme. The schematic at top shows T7p, a 20 bp spacer, and the sgRNA scaffold. Below is a schematic of synthetic DNA oligodimers. Below is a schematic of plasmid templates.

FIG. 32 demonstrates NHEJ repair in response to a double strand break. From top to bottom the figure illustrates an sg-RNA-Cas9 complex bound to a nucleic acid, adjacent to a PAM, inducing a double stranded break (DSB). NHEJ repairs can be error prone, leading to insertions (as shown in the circled, inserted A residue) or can lead to deletions (as shown in the circled region shown periods for deleted residues). Error-free repair is shown at the bottom FIG. 33 illustrates a schematic of CRISPR systems of the present invention which can include a TAG (at the N- or C-terminus), for example a purification tag like 6×HIS (SEQ ID NO: 78), an NLS (nuclear localization signal, at the N- or C-terminus), DME (DNA modifying enzyme), DBP (DNA binding protein), TdT (deoxyribonucleotidyl transferase), or stabilizing protein like GFP or other proteins fused in frame with N- or C-terminus of a gene editing (GE) effector protein, followed by Cas9 or Cpf1 (CRISPR genome editing effector proteins). TAG, NLS, DME, DBP, TdT, GFP etc. can be located at the N-terminus, C-terminus, or in an internal location relative to the effector protein (e.g., Cas9, Cpf1).

FIG. 34 illustrates a schematic of how the CRISPR PLUS chimeric polypeptides of the present disclosure reduce off target effects. Shown is a Cas9 adjacent to a PAM on a target nucleic acid strand. Following this is a schematic depicting double stranded breaks (DSBs). Below that is resection of the top and bottom nucleic acid strands. Below that is the NHEJ repair systems, which lead to error prone repair.

FIG. 35 illustrates at top 3 gels including M, 2 lanes of a Cas9, and 2 lanes of Cas9 PLUS. Time points shown are 24 and 48 h for each group. Shown below is a bar graph where the y-axis shows 0 to 60 in increments of 10. Groups tested were Cas9 and Cas9 PLUS. Within each group the bar to the left shows 24 h and the bar to the right shows 48 h.

FIG. 36 shows a schematic of DNA-free genome editing including taking tissues from plants and removing the cell wall to obtain protoplasts. This is followed by transfection of pre-assembled RNP (Cas9+gRNA), followed by genome editing. This leads to formation of the callus, followed by regeneration, and results in genome editing plants.

FIG. 37 illustrates genes to edit including example, *Arabidopsis* brassinosteroid mutants. Plants shown in the image at top include dwf at the left; on the top row: dwf1, dwf2, dwf3, and dwf4; on the bottom row: dwf5, dwf6, dwf7, and dwf12. In the bottom image, the figure shows *Arabidopsis* brassinosteroid biosynthetic mutants including wild type at left; on the top row: episterol to 5-dehydro episterol to 24-methylene cholesterol to campesterol; on the bottom row: campesterol, campestanol, to cathasterone, to testosterone.

FIG. 38 illustrates RNP of Cas9-sgRNA enters and edits protoplasts. At the top is a schematic of BRI1 (brassinosteroid insensitive 1), including primer F2, Target 1, Target 2, and primer R2. To the right is another schematic showing the heteroduplex-specific cutting by T7E1. Shown in the gels below are one day of treatment of 200K cells in 200 ul volume with 20 ug RNP with PEG induced indels. The two sets of gel at the left show T7E1 (+) at top and T7E1 (−) at bottom. Day 1 is shown in the first three lanes, which from left to right are (−), 20, and 60. Day 3 is shown in the next three lanes, which from left to right are (−), 20, and 60. In the 20 and 60 lanes for Day 1, percent indels were 71 and 54. In the 20 and 60 lanes for Day 3, percent indels were 69 and 71. The gel at the right shows leaf ages of 2 weeks: (−), 12, and 30 and the same for 4 weeks. The final lane shows no PEG.

FIG. 39 illustrates the double target method to delete intervening DNA. Text at the top states: 1. DNA spanning the 2 target sites was PCR amplified, 2. Cloned into a TA-cloning vector, and 3. Clones were randomly selected and Sanger sequenced: $^{23}/_{40}$=57.5(%).

FIG. 40 illustrates three sets of gels. The left most gel shows the PhyB group, without and with RNP from left to right. The middle gel shows the COl1 group, without and with RNP from left to right. The right gel shows the BRI1 group, without, with, and with RNP from left to right.

FIG. 41 shows off-target effects are low in *Arabidopsis* with graphs for PhyB, BRI1 TS1, and BRI1 TS2. For each group, mock and RGEN-RNP bars are shown. % indels are shown on the x axis.

FIG. 42 shows two sets of gel. The left gel set shows the DWD1 group, which from left to right shows lanes of 3-1, 3-2, and 3-3. The right gel set shows the CYPT24 group, which from left to right shows lanes of 3-1, 3-2, and 3-3. Protoplasts were used at $3\times10^4$ cell, Cas9 protein was used at 20 μg (final concentration: 50 ng/μl), sgRNA was used at 15 μg (final concentration: 38 ng/ul), PEG incubation condition was 20%, 15 min, and the total volume was 400 μl.

FIG. 43 illustrates at left *Arabidopsis* BIN2 (brassinosteroid insensitive 2): gain of function mutants. The image at left shows WT, heterozygous, and homozygous. Shown in the middle from top to bottom is a schematic of the target, the specific sequences of the target, and a gel, which shows from left to right a ladder; Ctrl with 0 μg sgRNA, 0 μg Cas9; 1 with 5 μg sgRNA, 2.5 μg Cas9, 2 with 10 μg sgRNA, 5 μg Cas9, and 10% indels; 3 with 20 μg sgRNA, 10 Cas9, and 14% indels, 4 with 40 μg sgRNA, 20 μg Cas9, and 8% indels, and 5 with 80 μg sgRNA, 40 μg Cas9, and 11% indels. At right are additional images of the plant shoots and protoplasts.

FIG. 44 shows plant regeneration numbered sequentially from 1 to 6. In image 1, the first round of division is shown, which occurred after 5 days of culture. In image 2, the $3^{rd}$ division is shown occurring after 7 days of culture. In image 3, a cell colony is shown having formed at the 12th day in protoplast culture. Images 4, 5, and 6, show continued growth and regeneration of lettuce.

Genome editing results in regeneration of plantlets in lettuce, as shown in FIG. 45. On the left hand side, from top to bottom, the images show the first round of division is shown, which occurred after 5 days of culture, the 3rd division is shown occurring after 7 days of culture, and a cell colony is shown having formed at the 12th day in protoplast culture. On the right hand side from bottom to top images show continued growth and regeneration of lettuce. These lettuce protoplasts are from LsBIN2 (RG4) editing line.

FIG. 46 illustrates regeneration of plantlets after genome editing in lettuce. At top is a gel, which from left to right shows the following lanes: target site, WT, T7 (11.20%) lanes of RG4-1, RG4-2, RG4-3, and RG4-4. Below the gel is a table, indicating values of 0.046% for WT, 4.5% for T7-RG4-1, 5.7% for T7-RG4-2, 3.8% for T7-RG4-3, and 3.2% for T7-RG4-4. Below are sequences of the mutated locus for RG4-1, RG4-2, and RG4-3.

FIG. 47 shows regeneration of whole plants from edited protoplasts, at the top left is WT (#28), at the top middle is bi-allelic KO (#24), and at the right is bi-allelic KO (#30).

FIG. 48 illustrates petri dishes of growing plants. At left is a schematic showing PCR to digestion, to run. Below the schematic is heteroduplex-specific cutting by T7E1. The center schematics show T7E1 vs RGEN-RFLP and wild type (WT), mono allele mutation (mono), bi allele mutation (hetero), and bi-allele mutation (homo).

FIG. 49 illustrates 3 plants including WT, bi-allelic, and bi-allelic, homo. Gels are shown for all three plants as are sequences. Gels are shown without RGEN and with RGEN. A ladder is shown in each gel followed by lanes from left to right of WT, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, and 35.

FIG. 50 illustrates shows the overall phenotype is not altered in biallelic heterozygous line. To the left is an image of a plant and underneath it is notated as #26, wild-type. To the right is an image of a plant and underneath it is notated with the WT sequence, an insertion notated as #24-A1 (+1), and a deletion notated as—A2 (−1).

FIG. 51 illustrates germline transmission of the edited mutations. At left are various plants from left to right labeled as T0-23 (WT), T0-10 (Δ3 bp/1 bp), T0-12 (1 bp/1 bp), T0-20 (Δ2 bp/1 bp), T0-24 (Δ1 bp/bp), and T0-25 (1 bp/+). The scale bar is 10 cm.

FIG. 52 illustrates a table of the number of potential off-target sites in the lettuce genome. The number of mismatches to on-target sites for 0, 1, 2, 3, 4, 5 and total are indicated for number of potential off-target sites, number of sites with appropriate PCR primers, and number of sites amplified successfully. For number of potential off-target sites, from left to right the number of mismatches are 1 (on-target), 0, 1, 4, 27, and 349, totaling 382. For number of sites with appropriate PCR primers, from left to right the number of mismatches are 1, 0, 1, 3, 24, and 72, totaling 101. For number of sites amplified successfully, from left to right the number of mismatches are 1, 0, 1, 3, 22, and 65, totaling 92, FIG. 53 illustrates low indel frequencies at the on-target and 91 potential off-target sites. For site name on-target, the sequence is shown, followed by % indels of 0.021 for WT, 99.912 for T0-20, 99.867 for T0-24, and 45.042 for T0-25, For site name OT1, the sequence is shown, followed by % indels of 0.022 for WT, 0.039 for T0-20, 0 for T0-24, and 0 for T0-25, For site name OT2, the sequence is shown, followed by % indels of 0 for WT, 0.014 for T0-20, 0.024 for T0-24, and 0.013 for T0-25, For site name OT3, the sequence is shown, followed by % indels of 0 for WT, 0 for T0-20, 0 for T0-24, and 0 for T0-25, For site name OT4, the sequence is shown, followed by % indels of 0.013 for WT, 0.3 for T0-20, 0.018 for T0-24, and 0 for T0-25, For site name OT5, the sequence is shown, followed by % indels of 0.023 for WT, 0.033 for T0-20, 0.029 for T0-24, and 0.012 for T0-25, For site name OT6, the sequence is shown, followed by % indels of 0.029 for WT, 0.03 for T0-20, 0.014 for T0-24, and 0.027 for T0-25, FIG. 54 illustrates gels at top (12 hours) and at bottom (24 hours). At top, lanes are from left to right the ladder, 1, plasmid DNA method for lanes 2-7, and RNP method for lanes 8-10. Indels (%) NGS are 0.020, 0.046, 0.021, 1.7, 4.6, 4.5, 4.2, 27, 8.7, and 48 for lanes 1-10, respectively. At top, lanes are from left to right the ladder, 1, plasmid DNA method for lanes 2-7, and RNP method for lanes 8-10. Indels (%) NGS are 0.0066, 0.042, 0.016, 4, 9.6, 9.6, 9.5, 36, 14, and 49 for lanes 1-10, respectively. Lane 1 shows control (PEG treatment only). Lane 2 shows 35Sp-Cas9 plasmid only 12 μg. Lane 3 shows U626p-phyB sgRNA plasmid only 12 μg. Lane 4 shows 35Sp-cas9 plasmid 6 μg+U626p-phyB sgRNA plasmid 3 μg. Lane 5 shows 35Sp-cas9 plasmid 3 μg+U626p-phyB sgRNA plasmid 6 μg. Lane 6 shows 35Sp-cas9 plasmid 12 μg+U626p-phyB sgRNA plasmid 12 μg.

Lane 7 shows 35Sp-cas9 plasmid 24 μg+U626p-phyB sgRNA plasmid 24 μg. Lane 8 shows phyB sgRNA (ggX20) 60 μg+cas9 protein 30 ug. Lane 9 shows phyB sgRNA (ggX20) 60 μg+cas9 protein 30 μg. Lane 10 shows phyB sgRNA (ggX19) 60 μg+cas9 protein 30 μg.

FIG. 55 illustrates Cas9 plasmid 3 mg+sgRNA plasmid 3 mg. A vevotr map is show in the middle of a cloning vector pYB196 T-DNA region, complete sequence. A sequence alignment is shown at bottom.

FIG. 56 shows a schematic of DNA-free genome editing including taking tissues from plants and removing the cell wall to obtain protoplasts. This is followed by transfection of pre-assembled RNP (Cas9+gRNA), followed by genome editing. This leads to formation of the callus, followed by regeneration, and results in genome editing plants.

FIG. 57 shows pros and cons of using RNPs for gene editing in plants, including lettuce, tomatoes, tubers, and beans. Pros include: Cas9 protein expression and sgRNA processing not needed, no foreign DNA remained in the genome, homozygous mutant at single generation, and simultaneous editing of multiple genes (multiplexing). Cons include: possibility of accompanying somaclonal variation and difficulty regeneration of whole plants from some crop protoplasts. RGEN RNPs can be used to induce targeted genome modifications in six genes in four species. RGEN-induced mutations were stably maintained in whole plants that were regenerated from the protoplasts and were transmitted to the germline. The resulting genome-edited plants might be exempt from current GMO regulations FIG. 58 illustrates a gel at top with substrate DNA from left to right (after the DNA ladder in the leftmost lane) of 0 11, 23, 34, 44, 57, 68, 79, and 90 nM. The cleavage rate from left to right (after the DNA ladder in the leftmost lane) is 0, 100, 98, 94, 83, 72, 63, 52, and 48%. Cut dsDAN concentration is 0, 11, 23, 32, 37, 41, 43, 41, and 43 nM. Shown below is a graph of reaction rate, [Podcuct]/hour from 0 to 50 in increments of 10. The x-axis shows the substrate concentration in nM from 0 to 100 in increments of 20.

FIG. 59 illustrates at top left two gels for SpyCas9, The top gel is a control and the bottom gel shows stop solution. Lanes show a DNA ladder and various time points. Time points include 0, 10, 30, 60, and 180 min. DNA band intensities as a percent for each lane in the top gel are 66, 85, 92, 100, and 100%, DNA band intensities as a percent for each lane in the bottom gel are 69, 87, 75, 47, and 68%. Arrows indicate "stop" in the bottom gel. Both gels show the uncut, cut 1, and cut 2 bands. At the top right are two gels for FnCpf1. The top gel is a control and the bottom gel shows stop solution. Lanes show a DNA ladder and various time points. Time points include 0, 10, 30, 60, and 180 min. DNA band intensities as a percent for each lane in the top gel are 0, 17, 36, 58, 86, and 94%, DNA band intensities as a percent for each lane in the bottom gel are 0, 24, 41, 34m 34, and 35%. Arrows indicate "stop" in the bottom gel. Both gels show the uncut, cut 1, and cut 2 bands. The graph at bottom shows on the y-axis % cleavage rate from 0 to 120 in increments of 20 and on the x-axis incubation time (min) from 0 to 210 in increments of 30, Shown in the graph are SpyCas9 without stop solution, FnCpf1 without stop solution, SpyCas9 with stop solution, and FnCpf1 with stop solution, Shown on the graph are arrows showing when stop solution was added, FIG. 60 illustrates two gels for SpyCas9. The gel at top shows the 1 h mark and with 1 μg. The gel at top shows the 3 h mark and with 1 μg. From left to right lanes are: a DNA ladder, PR product, pH values of 3, 4, 5, 6, 7, 8, 9, and 10, As shown at right bands from top to bottom are uncut, cut 1, and cut 2, DNA band intensities as a percent for each lane showing pH in the top gel are 0, 0, 0, 65, 80, 94, 97 and 100%. DNA band intensities as a percent for each lane showing pH in the bottom gel are 0, 0, 0, 71, 91, 94, 96, and 100%.

FIG. 61 illustrates 4 gels from top to bottom showing 63 nM nuclease, 125 nM nuclease, 250 nM nuclease, and 500 nM nuclease. The left 5 lanes are SpyCas9 and the right 5 lanes are SpyCas9-PLUS. A ladder is in the middle. Time-points of 0, 10, 30, 60, and 180 min were tested. Arrows indicate linear, coiled, and degraded products, FIG. 62 illustrates a schematic of Cas9 adjacent to a PAM bound to a nucleic acid. This is followed by generation of a double stranded break (DSB), followed by NHEJ repair. This can result in error-prone repair (insertions, then deletions are shown) or error-free repair.

FIG. 63 illustrates a schematic of Cas9 adjacent to a PAM bound to a nucleic acid. This is followed by generation of a double stranded break (DSB), followed by CRIPSR PLUS working, followed by NHEJ repair system. This leads to error prone repair.

FIG. 64 illustrates three gels. The top gel is −T7E1 with lanes from left to right of: ladder; Lipo−, RNP−; GFP-SpyCas9 with Lipo+, RNP+; GFP-SpyCas9 with Lipo−, RNP+; SpyCas9 with Lipo+, RNP+; SpyCas9 with Lipo+, RNP+; SpyCas9-PLUS with Lipo+, RNP+, and SpyCas9-PLUS with Lipo+, RNP+. The middle gel is +T7E1 with lanes from left to right of: ladder; Lipo−, RNP−; GFP-SpyCas9 with Lipo+, RNP+; GFP-SpyCas9 with Lipo−, RNP+; SpyCas9 with Lipo+, RNP+; SpyCas9 with Lipo+, RNP+; SpyCas9-PLUS with Lipo+, RNP+, and SpyCas9-PLUS with Lipo+, RNP+. Uncut and cut bands are shown to the right. The bottom gel shows SpyCas9/sgRNA. Uncut, cut 1, and cut 2 bands are shown.

FIG. 65 illustrates a box and whiskers plot with the x-axis showing the number of indels from 0 to 40 in increments of 5, The x-axis shows a first group of mungbean exonuclease treatment, which was added to Spy Cas9 and SpyCas9-PLUS, respectively. The x-axis shows a second group of T4 DNA polymerase treatment, which was added to Spy Cas9 and SpyCas9-PLUS, respectively.

FIG. 66 illustrates at top Cas 9 constructs comprising a tag, followed by NLS, followed by DME, DBP, TdT, GFP, etc, followed by Cas9, Cpf1, etc, followed by DME, DBP, TdT, GFP, etc, followed by NLS, followed by a tag. At middle the figure shows a gel. The left most lane is a ladder. This is followed by 4 lanes of commercial Cas9 at time points of 0, 12, 24, and 48 h. The next 4 lanes show another Cas9 at time points of 0, 12, 24, and 48 h The next 4 lanes show Cas9 PLUS at time points of 0, 24, 48, and 72 h. Cleaved fragments at 300 bps are shown to the left. At 48 h for commercial Cas9, % indels was 43. At 24 and 48 h for another Cas9, % indels was 15 and 42, For Cas9 PKUS at 24, 48, and 72 h was 43, 56, and 67, respectively.

FIG. 67 depicts three schematics of constructs of the present disclosure. At the top is a construct comprising a His-tag followed by SpyCas9 or FnCpf1, followed by exonuclease, GFP, and TdT, followed by BPNLS, followed by a His-tag. In the middle is a schematic of a construct showing a His tag followed by exonuclease, GFP, and DBP followed by SpyCas9 or FnCpf1, followed by BPNLS, followed by a His-tag. At the bottom is a construct comprising a His-tag followed by DBP followed by SpyCas9 or FnCpf1, followed by exonuclease (RecJ) followed by BPNLS, followed by a His-tag. The His tag is a 6×His tag (SEQ ID NO: 78), BPNLS is a nuclear localization signal, the exonuclease, DBP, TdT, and GFP is as follows exonuclease (RecJ, RecE, lambda, mungbean, and T5), DNA binding protein (DBP), deoxyribonucleotidyl transferase (TdT), or stabilizing protein like GFP or other proteins fused in frame with N- or C-terminus of GE effector protein. The SpyCas9 and FnCpf1 are CRIPSR genome editing effector proteins.

FIG. 68 at top shows the nucleotide sequence of a region of CCR5 including the exon 3 region, which is indicated below the sequence. Below "exon 3" is an indication of the region of the nucleotide sequence corresponding to the protospacer, immediately followed by the PAM. An arrow above and below the sequence indicates nuclease cutting sites. FIG. 68 at bottom shows the nucleotide sequence of a region of DHCR7 including exon 4 region, which is indicated below the sequence. Below "exon 4" is an indication of the region of the nucleotide sequence corresponding to the protospacer, immediately followed by the PAM. An arrow above and below the sequence indicates nuclease cutting sites.

FIG. 69 at top shows the nucleotide sequence of a region of CCR5 including the exon 3 region, which is indicated below the sequence. Below "exon 3" is an indication of the region of the nucleotide sequence corresponding to the protospacer, immediately preceded by the PAM. An arrow above and below the sequence indicates nuclease cutting sites. FIG. 68 at bottom shows the nucleotide sequence of a region of DNMT1 including exon 40 and exon 41 region, which is indicated below the sequence. Below the exon 40 and the exon 41 is an indication of the region of the nucleotide sequence corresponding to the protospacer, immediately preceded by the PAM. An arrow above and below the sequence indicates nuclease cutting sites.

FIG. 70 at top shows a gel showing % editing efficiency in an in vitro cleavage assay. The lanes from left to right show Control A, Control B, Control C, Control D, SpyCas9, SpyCas9-GFP, SpyCas9-hTdT, SpyCas9-RecJ, SpyCas9-RecE, SpyCas9-lambda, SpyCas9-mungbean, and SpyCas9-T5. The percent efficiency for each group starting from Control C and onwards is shown below each lane and from left to right reads 100, 100, 98, 97, 98, 98, 94, 97, 98, and 61. A DNA ladder is shown in the left most lane. Indicated at the right of the gel is position at which the substrate resolves at 1347 bp and the position at which the cleaved product resolves at 672 bp. Shown below the gel is a bar graph showing percent cleavage efficiency on the y-axis from 0 to 120 in increments of 20 and shown on the x-axis are each of the groups including from left to right, Control C, Control D, SpyCas9, SpyCas9-GFP, SpyCas9-hTdT, SpyCas9-RecJ, SpyCas9-RecE, SpyCas9-lambda, SpyCas9-Mungbean, and SpyCas9-T5.

FIG. 71 at top shows a gel showing % editing efficiency in an in vitro cleavage assay. The lanes from left to right show Control A, Control B, SpyCas9, RecJ-SpyCas9, RecE-SpyCas9, GFP-SpyCas9, SSB-SpyCas9, SSB-SpyCas9-RecJ, DSB-SpyCas9, and DSB-SpyCas9-RecJ. The percent efficiency for each group from SpyCas9 and onwards is shown below each lane and from left to right reads 99, 99, 99, 99, 85, 98, 99, and 99. A DNA ladder is shown in the left most lane. Indicated at the right of the gel is position at which the substrate resolves at 1347 bp and the position at which the cleaved product resolves at 672 bp. Shown below the gel is a bar graph showing percent cleavage efficiency on the y-axis from 0 to 120 in increments of 20 and shown on the x-axis are each of the groups including from left to right, SpyCas9, RecJ-SpyCas9, RecE-SpyCas9, GFP-SpyCas9, SSB-SpyCas9, SSB-SpyCas9-RecJ, DSB-SpyCas9, and DSB-SpyCas9-Rec.

FIG. 72 at top shows a gel showing % editing efficiency in an in vitro cleavage assay. The lanes from left to right show Control A, FnCpf1, FnCpf1-RecJ, FnCpf1-RecE, FnCpf1-hTdT, FnCpf1-T5, FnCpf1-lambda, FnCpf1-mungbean, and FnCpf1-GFP. The percent efficiency for each group from FnCpf1 and onwards is shown below each lane and from left to right reads 14, 46, 0, 3, 78, 55, 0, and 49. A DNA ladder is shown in the left most lane. Indicated at the right of the gel is position at which the substrate resolves at 1100 bp and the position at which the first cleaved product ("cleaved1") resolves at 680 bp and the position at which the second cleaved product ("cleaved2") resolves at 420 bp. Shown below the gel is a bar graph showing percent cleavage efficiency on the y-axis from 0 to 100 in increments of 20 and shown on the x-axis are each of the groups including from left to right, FnCpf1, FnCpf1-RecJ, FnCpf1-RecE, FnCpf1-hTdT, FnCpf1-T5, FnCpf1-lambda, FnCpf1-mungbean, and FnCpf1-GFP.

FIG. 73 at top shows a gel showing % editing efficiency in an in vitro cleavage assay. The lanes from left to right show Control A, FnCpf1, RecJ-FnCpf1, GFP-FnCpf1, DSB-FnCpf1, SSB-FnCpf1, and SSB-FnCpf1-RecJ. The percent efficiency for each group from FnCpf1 and onwards is shown below each lane and from left to right reads 31, 24, 0, 0, 22, and 3. A DNA ladder is shown in the left most lane. Indicated at the right of the gel is position at which the substrate resolves at 1100 bp and the position at which the first cleaved product ("cleaved1") resolves at 680 bp and the position at which the second cleaved product ("cleaved2") resolves at 420 bp. Shown below the gel is a bar graph showing percent cleavage efficiency on the y-axis from 0 to 50 in increments of 10 and shown on the x-axis are each of the groups including from left to right, FnCpf1, RecJ-FnCpf1, GFP-FnCpf1, DSB-FnCpf1, SSB-FnCpf1, and SSB-FnCpf1-RecJ.

FIG. 74 at left shows a bar graph of percent knock-out efficiency. The y-axis shows indels (%) in increments of 2 from 0 to 10. The bar graph shows a pair of bars per group with the bar to the left in a pair indicating CCR5 and the bar to the right in a pair indicating DHCR7. The groups on the x-axis from left to right are mock, SpyCas9, SpyCas9-GFP, SpyCas9-hTdT, SpyCas9-RecJ, SpyCas9-RecE, SpyCas9-lambda, SpyCas9-mungbean, and SpyCas9-T5. FIG. 74 at right shows a bar graph of percent knock-in efficiency. The y-axis shows homology directed repair (HDR) (%) in increments of 5 from 0 to 30. The bar graph shows a pair of bars per group with the bar to the left in a pair indicating CCR5 and the bar to the right in a pair indicating DHCR7. The groups on the x-axis from left to right are mock, SpyCas9, SpyCas9-GFP, SpyCas9-hTdT, SpyCas9-RecJ, SpyCas9-RecE, SpyCas9-lambda, SpyCas9-mungbean, and SpyCas9-T5.

FIG. 75 shows at top a schematic of a construct of the present disclosure, which from left to right includes a His-tag, a SpyCas9, GFP, BPNLS, and a His-tag. Shown in the middle is a bar graph of knock-out efficiency. The y-axis shows indels (%) in increments of 1 from 0 to 7. The bar graph shows a pair of bars per group with the bar to the left in a pair indicating CCR5 and the bar to the right in a pair indicating DHCR7. The groups on the x-axis from left to right are mock, SpyCas9, and SpyCas9-GFP. Shown at the bottom is a table of percent change in efficiency of SpyCas9-GFP over SpyCas9, which is indicated as +10% for CCR5 and +130% for DHCR7 for SpyCas9-GFP.

FIG. 76 shows at top a schematic of a construct of the present disclosure, which from left to right includes a His-tag, a SpyCas9, GFP, BPNLS, and a His-tag. Shown in the middle is a bar graph of knock-in efficiency. The y-axis shows homology directed repair (HDR) (%) in increments of 2 from 0 to 18. The bar graph shows a pair of bars per group with the bar to the left in a pair indicating CCR5 and the bar to the right in a pair indicating DHCR7. The groups on the x-axis from left to right are mock, SpyCas9, and SpyCas9-GFP. Shown at the bottom is a table of percent change in efficiency of SpyCas9-GFP over SpyCas9, which is indicated as +20% for CCR5 and +70% for DHCR7 for Spy-Cas9-GFP.

FIG. 77 shows at top a schematic of a construct of the present disclosure, which from left to right includes a His-tag, a SpyCas9, hTdT, BPNLS, and a His-tag. Shown in the middle is a bar graph of knock-out efficiency. The y-axis shows indels (%) in increments of 1 from 0 to 6. The bar graph shows a pair of bars per group with the bar to the left in a pair indicating CCR5 and the bar to the right in a pair indicating DHCR7. The groups on the x-axis from left to right are mock, SpyCas9, and SpyCas9-hTdT. Shown at the bottom is a table of percent change in efficiency of SpyCas9-hTdT over SpyCas9, which is indicated as −40% for CCR5 and 0% for DHCR7 for SpyCas9-hTdT.

FIG. 78 shows at top a schematic of a construct of the present disclosure, which from left to right includes a His-tag, a SpyCas9, hTdT, BPNLS, and a His-tag. Shown in the middle is a bar graph of knock-in efficiency. The y-axis shows homology directed repair (HDR) (%) in increments of 2 from 0 to 16. The bar graph shows a pair of bars per group with the bar to the left in a pair indicating CCR5 and the bar to the right in a pair indicating DHCR7. The groups on the x-axis from left to right are mock, SpyCas9, and SpyCas9-hTdT. Shown at the bottom is a table of percent change in efficiency of SpyCas9-hTdT over SpyCas9, which is indicated as −20% for CCR5 and 0% for DHCR7 for SpyCas9-hTdT.

FIG. 79 shows at top a schematic of a construct of the present disclosure, which from left to right includes a His-tag, a SpyCas9, RecJ, BPNLS, and a His-tag. Shown in the middle is a bar graph of knock-out efficiency. The y-axis shows indels (%) in increments of 1 from 0 to 8. The bar graph shows a pair of bars per group with the bar to the left in a pair indicating CCR5 and the bar to the right in a pair indicating DHCR7. The groups on the x-axis from left to right are mock, SpyCas9, and SpyCas9-RecJ. Shown at the bottom is a table of percent change in efficiency of SpyCas9-RecJ over SpyCas9, which is indicated as +30% for CCR5 and +170% for DHCR7 for SpyCas9-RecJ.

FIG. 80 shows at top a schematic of a construct of the present disclosure, which from left to right includes a His-tag, a SpyCas9, RecJ, BPNLS, and a His-tag. Shown in the middle is a bar graph of knock-in efficiency. The y-axis shows homology directed repair (HDR) (%) in increments of 5 from 0 to 20. The bar graph shows a pair of bars per group with the bar to the left in a pair indicating CCR5 and the bar to the right in a pair indicating DHCR7. The groups on the x-axis from left to right are mock, SpyCas9, and SpyCas9-RecJ. Shown at the bottom is a table of percent change in efficiency of SpyCas9-RecJ over SpyCas9, which is indicated as +30% for CCR5 and +30% for DHCR7 for SpyCas9-RecJ.

FIG. 81 shows at top a schematic of a construct of the present disclosure, which from left to right includes a His-tag, a SpyCas9, RecE, BPNLS, and a His-tag. Shown in the middle is a bar graph of knock-out efficiency. The y-axis shows indels (%) in increments of 1 from 0 to 6. The bar graph shows a pair of bars per group with the bar to the left in a pair indicating CCR5 and the bar to the right in a pair indicating DHCR7. The groups on the x-axis from left to right are mock, SpyCas9, and SpyCas9-RecE. Shown at the bottom is a table of percent change in efficiency of SpyCas9-RecE over SpyCas9, which is indicated as −90% for CCR5 and −70% for DHCR7 for SpyCas9-RecE.

FIG. 82 shows at top a schematic of a construct of the present disclosure, which from left to right includes a His-tag, a SpyCas9, RecE, BPNLS, and a His-tag. Shown in the middle is a bar graph of knock-in efficiency. The y-axis shows homology directed repair (HDR) (%) in increments of 2 from 0 to 16. The bar graph shows a pair of bars per group with the bar to the left in a pair indicating CCR5 and the bar to the right in a pair indicating DHCR7. The groups on the x-axis from left to right are mock, SpyCas9, and SpyCas9-RecE. Shown at the bottom is a table of percent change in efficiency of SpyCas9-RecE over SpyCas9, which is indicated as −100% for CCR5 and −100% for DHCR7 for SpyCas9-RecE.

FIG. 83 shows at top a schematic of a construct of the present disclosure, which from left to right includes a His-tag, a SpyCas9, lambda, BPNLS, and a His-tag. Shown in the middle is a bar graph of knock-out efficiency. The y-axis shows indels (%) in increments of 1 from 0 to 6. The bar graph results for CCR5. The groups on the x-axis from left to right are mock, SpyCas9, and SpyCas9-lambda. Shown at the bottom is a table of percent change in efficiency of SpyCas9-lambda over SpyCas9, which is indicated as −50% for CCR5 and n.s.d. for DHCR7 for SpyCas9-lambda.

FIG. 84 shows at top a schematic of a construct of the present disclosure, which from left to right includes a His-tag, a SpyCas9, lambda, BPNLS, and a His-tag. Shown in the middle is a bar graph of knock-in efficiency. The y-axis shows homology directed repair (HDR) (%) in increments of 2 from 0 to 16. The bar graph shows a pair of bars per group with the bar to the left in a pair indicating CCR5 and the bar to the right in a pair indicating DHCR7. The groups on the x-axis from left to right are mock, SpyCas9, and SpyCas9-lambda. Shown at the bottom is a table of percent change in efficiency of SpyCas9-lambda over SpyCas9, which is indicated as −30% for CCR5 and −50% for DHCR7 for SpyCas9-lambda.

FIG. 85 shows at top a schematic of a construct of the present disclosure, which from left to right includes a His-tag, a SpyCas9, mungbean, BPNLS, and a His-tag. Shown in the middle is a bar graph of knock-out efficiency. The y-axis shows indels (%) in increments of 1 from 0 to 6. The bar graph shows a pair of bars per group with the bar to the left in a pair indicating CCR5 and the bar to the right in a pair indicating DHCR7. The groups on the x-axis from left to right are mock, SpyCas9, and SpyCas9-mungbean. Shown at the bottom is a table of percent change in efficiency of SpyCas9-mungbean over SpyCas9, which is indicated as −60% for CCR5 and −50% for DHCR7 for SpyCas9-mungbean.

FIG. 86 shows at top a schematic of a construct of the present disclosure, which from left to right includes a His-tag, a SpyCas9, mungbean, BPNLS, and a His-tag. Shown in the middle is a bar graph of knock-in efficiency. The y-axis shows homology directed repair (HDR) (%) in increments of 2 from 0 to 16. The bar graph shows a pair of bars per group with the bar to the left in a pair indicating CCR5 and the bar to the right in a pair indicating DHCR7. The groups on the x-axis from left to right are mock, SpyCas9, and SpyCas9-mungbean. Shown at the bottom is a table of percent change in efficiency of SpyCas9-mungbean over SpyCas9, which is indicated as −60% for CCR5 and −70% for DHCR7 for SpyCas9-mungbean.

FIG. 87 shows at top a schematic of a construct of the present disclosure, which from left to right includes a His-tag, a SpyCas9, T5, BPNLS, and a His-tag. Shown in the middle is a bar graph of knock-out efficiency. The y-axis shows indels (%) in increments of 1 from 0 to 6. The bar graph shows a pair of bars per group with the bar to the left in a pair indicating CCR5 and the bar to the right in a pair indicating DHCR7. The groups on the x-axis from left to right are mock, SpyCas9, and SpyCas9-T5. Shown at the bottom is a table of percent change in efficiency of SpyCas9-T5 over SpyCas9, which is indicated as −90% for CCR5 and −70% for DHCR7 for SpyCas9-T5.

FIG. 88 shows at top a schematic of a construct of the present disclosure, which from left to right includes a His-tag, a SpyCas9, T5, BPNLS, and a His-tag. Shown in the middle is a bar graph of knock-in efficiency. The y-axis shows homology directed repair (HDR) (%) in increments of 2 from 0 to 16. The bar graph shows a pair of bars per group with the bar to the left in a pair indicating CCR5 and the bar to the right in a pair indicating DHCR7. The groups on the x-axis from left to right are mock, SpyCas9, and SpyCas9-T5. Shown at the bottom is a table of percent change in efficiency of SpyCas9-T5 over SpyCas9, which is indicated as −90% for CCR5 and −90% for DHCR7 for SpyCas9-T5.

FIG. 89 at left shows a bar graph of percent knock-out efficiency. The y-axis shows indels (%) in increments of 0.5 from 0 to 2.5. The bar graph indicates DHCR7. The groups on the x-axis from left to right are mock, SpyCas9, RecJ-SpyCas9, RecE-SpyCas9, GFP-SpyCas0, SSB-SpyCas9, SSB-SpyCas9-RecJ, DSB-SpyCas9, and DSB-SpyCas9-RecJ. FIG. 89 at right shows a bar graph of percent knock-in efficiency. The y-axis shows homology directed repair (HDR) (%) in increments of 10 from 0 to 60. The bar graph indicates DHCR7. The groups on the x-axis from left to right are mock, SpyCas9, RecJ-SpyCas9, RecE-SpyCas9, GFP-SpyCas0, SSB-SpyCas9, SSB-SpyCas9-RecJ, DSB-SpyCas9, and DSB-SpyCas9-RecJ.

FIG. 90 shows at top a schematic of a construct of the present disclosure, which from left to right includes a His-tag, RecJ, a SpyCas9, BPNLS, and a His-tag. Shown in the middle is a bar graph of knock-out efficiency. The y-axis shows indels (%) in increments of 0.2 from 0 to 2. The bar graph indicates DHCR7. The groups on the x-axis from left to right are mock, SpyCas9, and RecJ-SpyCas9. Shown at the bottom is a table of percent change in efficiency of RecJ-SpyCas9 over SpyCas9, which is indicated as +20% for DHCR7 for RecJ-SpyCas9.

FIG. 91 shows at top a schematic of a construct of the present disclosure, which from left to right includes a His-tag, RecJ, a SpyCas9, BPNLS, and a His-tag. Shown in the middle is a bar graph of knock-in efficiency. The y-axis shows homology directed repair (HDR) (%) in increments of 10 from 0 to 60. The bar graph indicates DHCR7. The groups on the x-axis from left to right are mock, SpyCas9, and RecJ-SpyCas9. Shown at the bottom is a table of percent change in efficiency of RecJ-SpyCas9 over SpyCas9, which is indicated as +1770% for DHCR7 for RecJ-SpyCas9.

FIG. 92 shows at top a schematic of a construct of the present disclosure, which from left to right includes a His-tag, RecE, a SpyCas9, BPNLS, and a His-tag. Shown in the middle is a bar graph of knock-out efficiency. The y-axis shows indels (%) in increments of 0.2 from 0 to 1.8. The bar graph indicates DHCR7. The groups on the x-axis from left to right are mock, SpyCas9, and RecE-SpyCas9. Shown at the bottom is a table of percent change in efficiency of RecE-SpyCas9 over SpyCas9, which is indicated as −20% for DHCR7 for RecE-SpyCas9.

FIG. 93 shows at top a schematic of a construct of the present disclosure, which from left to right includes a His-tag, RecE, a SpyCas9, BPNLS, and a His-tag. Shown in the middle is a bar graph of knock-in efficiency. The y-axis shows homology directed repair (HDR) (%) in increments of 1 from 0 to 6. The bar graph indicates DHCR7. The groups on the x-axis from left to right are mock, SpyCas9, and RecE-SpyCas9. Shown at the bottom is a table of percent change in efficiency of RecE-SpyCas9 over SpyCas9, which is indicated as +60% for DHCR7 for RecE-SpyCas9.

FIG. 94 shows at top a schematic of a construct of the present disclosure, which from left to right includes a His-tag, GFP, a SpyCas9, BPNLS, and a His-tag. Shown in the middle is a bar graph of knock-out efficiency. The y-axis shows indels (%) in increments of 0.5 from 0 to 2.5. The bar graph indicates DHCR7. The groups on the x-axis from left to right are mock, SpyCas9, and GFP-SpyCas9. Shown at the bottom is a table of percent change in efficiency of GFP-SpyCas9 over SpyCas9, which is indicated as +30% for DHCR7 for GFP-SpyCas9.

FIG. 95 shows at top a schematic of a construct of the present disclosure, which from left to right includes a His-tag, GFP, a SpyCas9, BPNLS, and a His-tag. Shown in the middle is a bar graph of knock-in efficiency. The y-axis shows homology directed repair (HDR) (%) in increments of 0.5 from 0 to 3.5. The bar graph indicates DHCR7. The groups on the x-axis from left to right are mock, SpyCas9, and GFP-SpyCas9. Shown at the bottom is a table of percent change in efficiency of GFP-SpyCas9 over SpyCas9, which is indicated as +10% for DHCR7 for GFP-SpyCas9.

FIG. 96 shows at top a schematic of a construct of the present disclosure, which from left to right includes a His-tag, SSB, a SpyCas9, BPNLS, and a His-tag. Shown in the middle is a bar graph of knock-out efficiency. The y-axis shows indels (%) in increments of 0.2 from 0 to 1.8. The bar graph indicates DHCR7. The groups on the x-axis from left to right are mock, SpyCas9, and SSB-SpyCas9. Shown at the bottom is a table of percent change in efficiency of SSB-SpyCas9 over SpyCas9, which is indicated as −20% for DHCR7 for SSB-SpyCas9.

FIG. 97 shows at top a schematic of a construct of the present disclosure, which from left to right includes a His-tag, SSB, a SpyCas9, BPNLS, and a His-tag. Shown in the middle is a bar graph of knock-in efficiency. The y-axis shows homology directed repair (HDR) (%) in increments of 0.5 from 0 to 3.5. The bar graph indicates DHCR7. The groups on the x-axis from left to right are mock, SpyCas9, and SSB-SpyCas9. Shown at the bottom is a table of percent change in efficiency of SSB-SpyCas9 over SpyCas9, which is indicated as −50% for DHCR7 for SSB-SpyCas9.

FIG. 98 shows at top a schematic of a construct of the present disclosure, which from left to right includes a His-tag, SSB, a SpyCas9, RecJ, BPNLS, and a His-tag. Shown in the middle is a bar graph of knock-out efficiency. The y-axis shows indels (%) in increments of 0.2 from 0 to 1.8. The bar graph indicates DHCR7. The groups on the x-axis from left to right are mock, SpyCas9, and SSB-SpyCas9-RecJ. Shown at the bottom is a table of percent change in efficiency of SSB-SpyCas9-RecJ over SpyCas9, which is indicated as 0% for DHCR7 for SSB-SpyCas9-RecJ.

FIG. 99 shows at top a schematic of a construct of the present disclosure, which from left to right includes a His-tag, DSB, a SpyCas9, BPNLS, and a His-tag. Shown in the middle is a bar graph of knock-out efficiency. The y-axis shows indels (%) in increments of 0.2 from 0 to 1.8. The bar graph indicates DHCR7. The groups on the x-axis from left to right are mock, SpyCas9, and DSB-SpyCas9. Shown at the bottom is a table of percent change in efficiency of SSB-SpyCas9 over SpyCas9, which is indicated as 0% for DHCR7 for SSB-SpyCas9.

FIG. 100 shows at top a schematic of a construct of the present disclosure, which from left to right includes a His-tag, DSB, a SpyCas9, RecJ, BPNLS, and a His-tag. Shown in the middle is a bar graph of knock-out efficiency. The y-axis shows indels (%) in increments of 0.2 from 0 to 1.8. The bar graph indicates DHCR7. The groups on the x-axis from left to right are mock, SpyCas9, and DSB-SpyCas9-RecJ. Shown at the bottom is a table of percent change in efficiency of SSB-SpyCas9-RecJ over SpyCas9, which is indicated as −50% for DHCR7 for SSB-SpyCas9-RecJ.

FIG. 101 at left shows a bar graph of percent knock-out efficiency. The y-axis shows indels (%) in increments of 1 from 0 to 5. The bar graph shows a pair of bars per group with the bar to the left in a pair indicating CCR5 and the bar to the right in a pair indicating DNMT1. The groups on the x-axis from left to right are mock, FnCpf1, FnCpf1-RecJ, FnCpf1-RecE, FnCpf1-hTdT, FnCpf1-T5, FnCpf1-lambda, FnCpf1-mungbean, and FnCpf1-GFP. FIG. 101 at right shows a bar graph of percent knock-in efficiency. The y-axis shows homology directed repair (HDR) (%) in increments of 1 from 0 to 5. The bar graph shows a pair of bars per group with the bar to the left in a pair indicating CCR5 and the bar to the right in a pair indicating DNMT1. The groups on the x-axis from left to right are mock, FnCpf1, FnCpf1-RecJ, FnCpf1-RecE, FnCpf1-hTdT, FnCpf1-T5, FnCpf1-lambda, FnCpf1-mungbean, and FnCpf1-GFP.

FIG. 102 shows at top a schematic of a construct of the present disclosure, which from left to right includes a His-tag, an FnCpf1, RecJ, BPNLS, and a His-tag. Shown in the middle is a bar graph of knock-out efficiency. The y-axis shows indels (%) in increments of 0.5 from 0 to 4.5. The bar graph shows a pair of bars per group with the bar to the left in a pair indicating CCR5 and the bar to the right in a pair indicating DNMT1. The groups on the x-axis from left to right are mock, an FnCpf1, and FnCpf1-RecJ. Shown at the bottom is a table of percent change in efficiency of an FnCpf1-RecJ over an FnCpf1, which is indicated as +70% for CCR5 and +110% for DNMT1 for FnCpf1-RecJ.

FIG. 103 shows at top a schematic of a construct of the present disclosure, which from left to right includes a His-tag, an FnCpf1, RecJ, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, FnCpf1, and FnCpf1-RecJ. Shown at the bottom is a table of percent change in efficiency of FnCpf1-RecJ over FnCpf1, which is indicated as −70% for CCR5 and −40% for DNMT1 for FnCpf1-RecJ.

FIG. 104 shows at top a schematic of a construct of the present disclosure, which from left to right includes a His-tag, an FnCpf1, RecE, BPNLS, and a His-tag. Shown in the middle is a bar graph of knock-out efficiency. The y-axis shows indels (%) in increments of 0.5 from 0 to 2.5. The bar graph shows a pair of bars per group with the bar to the left in a pair indicating CCR5 and the bar to the right in a pair indicating DNMT1. The groups on the x-axis from left to right are mock, an FnCpf1, and FnCpf1-RecE. Shown at the bottom is a table of percent change in efficiency of an FnCpf1-RecE over an FnCpf1, which is indicated as −80% for CCR5 and −90% for DNMT1 for FnCpf1-RecE.

FIG. 105 shows at top a schematic of a construct of the present disclosure, which from left to right includes a His-tag, an FnCpf1, RecE, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, FnCpf1, and FnCpf1-RecE. Shown at the bottom is a table of percent change in efficiency of FnCpf1-RecE over FnCpf1, which is indicated as −100% for CCR5 and −100% for DNMT1 for FnCpf1-RecE.

FIG. 106 shows at top a schematic of a construct of the present disclosure, which from left to right includes a His-tag, an FnCpf1, hTdT, BPNLS, and a His-tag. Shown in the middle is a bar graph of knock-out efficiency. The y-axis shows indels (%) in increments of 0.5 from 0 to 2.5. The bar graph shows a pair of bars per group with the bar to the left in a pair indicating CCR5 and the bar to the right in a pair indicating DNMT1. The groups on the x-axis from left to right are mock, an FnCpf1, and FnCpf1-hTdT. Shown at the bottom is a table of percent change in efficiency of an FnCpf1-hTdT over an FnCpf1, which is indicated as −80% for CCR5 and −90% for DNMT1 for FnCpf1-hTdT.

FIG. 107 shows at top a schematic of a construct of the present disclosure, which from left to right includes a His-tag, an FnCpf1, hTdT, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, FnCpf1, and FnCpf1-hTdT. Shown at the bottom is a table of percent change in efficiency of FnCpf1-hTdT over FnCpf1, which is indicated as −80% for CCR5 and −80% for DNMT1 for FnCpf1-hTdT.

FIG. 108 shows at top a schematic of a construct of the present disclosure, which from left to right includes a His-tag, an FnCpf1, T5, BPNLS, and a His-tag. Shown in the middle is a bar graph of knock-out efficiency. The y-axis shows indels (%) in increments of 0.5 from 0 to 2.5. The bar graph shows a pair of bars per group with the bar to the left in a pair indicating CCR5 and the bar to the right in a pair indicating DNMT1. The groups on the x-axis from left to right are mock, an FnCpf1, and FnCpf1-T5. Shown at the bottom is a table of percent change in efficiency of an FnCpf1-T5 over an FnCpf1, which is indicated as −80% for CCR5 and −90% for DNMT1 for FnCpf1-T5.

FIG. 109 shows at top a schematic of a construct of the present disclosure, which from left to right includes a His-tag, an FnCpf1, T5, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, FnCpf1, and FnCpf1-T5. Shown at the bottom is a table of percent change in efficiency of FnCpf1-T5 over FnCpf1, which is indicated as −100% for CCR5 and −100% for DNMT1 for FnCpf1-T5.

FIG. 110 shows at top a schematic of a construct of the present disclosure, which from left to right includes a His-tag, an FnCpf1, lambda, BPNLS, and a His-tag. Shown in the middle is a bar graph of knock-out efficiency. The y-axis shows indels (%) in increments of 0.5 from 0 to 2.5. The bar graph shows a pair of bars per group with the bar to the left in a pair indicating CCR5 and the bar to the right in a pair indicating DNMT1. The groups on the x-axis from left to right are mock, an FnCpf1, and FnCpf1-lambda. Shown at the bottom is a table of percent change in efficiency of an FnCpf1-lambda over an FnCpf1, which is indicated as −70% for CCR5 and −60% for DNMT1 for FnCpf1-lambda.

FIG. 111 shows at top a schematic of a construct of the present disclosure, which from left to right includes a His-tag, an FnCpf1, lambda, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, FnCpf1, and FnCpf1-lambda. Shown at the bottom is a table of percent change in efficiency of FnCpf1-lambda over FnCpf1, which is indicated as −70% for CCR5 and −60% for DNMT1 for FnCpf1-lambda.

FIG. 112 shows at top a schematic of a construct of the present disclosure, which from left to right includes a His-tag, an FnCpf1, mungbean, BPNLS, and a His-tag. Shown in the middle is a bar graph of knock-out efficiency. The y-axis shows indels (%) in increments of 0.5 from 0 to 2.5. The bar graph shows a pair of bars per group with the bar to the left in a pair indicating CCR5 and the bar to the right in a pair indicating DNMT1. The groups on the x-axis from left to right are mock, an FnCpf1, and FnCpf1-mungbean. Shown at the bottom is a table of percent change in efficiency of an FnCpf1-mungbean over an FnCpf1, which is indicated as −80% for CCR5 and −90% for DNMT1 for FnCpf1-mungbean.

FIG. 113 shows at top a schematic of a construct of the present disclosure, which from left to right includes a His-tag, an FnCpf1, mungbean, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, FnCpf1, and FnCpf1-mungbean. Shown at the bottom is a table of percent change in efficiency of FnCpf1-mungbean over FnCpf1, which is indicated as −100% for CCR5 and −100% for DNMT1 for FnCpf1-mungbean.

FIG. 114 shows at top a schematic of a construct of the present disclosure, which from left to right includes a His-tag, an FnCpf1, GFP, BPNLS, and a His-tag. Shown in the middle is a bar graph of knock-out efficiency. The y-axis shows indels (%) in increments of 0.5 from 0 to 3. The bar graph shows a pair of bars per group with the bar to the left in a pair indicating CCR5 and the bar to the right in a pair indicating DNMT1. The groups on the x-axis from left to right are mock, an FnCpf1, and FnCpf1-GFP. Shown at the bottom is a table of percent change in efficiency of an FnCpf1-GFP over an FnCpf1, which is indicated as 0% for CCR5 and +30% for DNMT1 for FnCpf1-GFP.

FIG. 115 shows at top a schematic of a construct of the present disclosure, which from left to right includes a His-tag, an FnCpf1, GFP, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, FnCpf1, and FnCpf1-GFP. Shown at the bottom is a table of percent change in efficiency of FnCpf1-GFP over FnCpf1, which is indicated as 0% for CCR5 and +10% for DNMT1 for FnCpf1-GFP.

FIG. 116 at left shows a bar graph of percent knock-out efficiency. The y-axis shows indels (%) in increments of 0.5 from 0 to 2. The bar graph shows a pair of bars per group with the bar to the left in a pair indicating CCR5 and the bar to the right in a pair indicating DNMT1. The groups on the x-axis from left to right are mock, FnCpf1, RecJ-FnCpf1, GFP-FnCpf1, SSB-FnCpf1, SSB-FnCpf1-RecJ, and DSB-FnCpf1. FIG. 116 at right shows a bar graph of percent knock-in efficiency. The y-axis shows homology directed repair (HDR) (%) in increments of 1 from 0 to 5. The bar graph shows a pair of bars per group with the bar to the left in a pair indicating CCR5 and the bar to the right in a pair indicating DNMT1. The groups on the x-axis from left to right are mock, FnCpf1, RecJ-FnCpf1, GFP-FnCpf1, SSB-FnCpf1, SSB-FnCpf1-RecJ, and DSB-FnCpf1, FIG. 117 shows at top a schematic of a construct of the present disclosure, which from left to right includes a His-tag, RecJ, an FnCpf1, BPNLS, and a His-tag. Shown in the middle is a bar graph of knock-out efficiency. The y-axis shows indels (%) in increments of 0.2 from 0 to 1.2. The bar graph shows a pair of bars per group with the bar to the left in a pair indicating CCR5 and the bar to the right in a pair indicating DNMT1. The groups on the x-axis from left to right are mock, an FnCpf1, and RecJ-FnCpf1. Shown at the bottom is a table of percent change in efficiency of RecJ-FnCpf1 over an FnCpf1, which is indicated as −30% for CCR5 and −60% for DNMT1 for RecJ-FnCpf1.

FIG. 118 shows at top a schematic of a construct of the present disclosure, which from left to right includes a His-tag, RecJ, an FnCpf1, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, an FnCpf1, and RecJ-FnCpf1. Shown at the bottom is a table of percent change in efficiency of RecJ-FnCpf1 over FnCpf1, which is indicated as −80% for CCR5 and −80% for DNMT1 for RecJ-FnCpf1.

FIG. 119 shows at top a schematic of a construct of the present disclosure, which from left to right includes a His-tag, GFP, an FnCpf1, BPNLS, and a His-tag. Shown in the middle is a bar graph of knock-out efficiency. The y-axis shows indels (%) in increments of 0.2 from 0 to 1.2. The bar graph shows a pair of bars per group with the bar to the left in a pair indicating CCR5 and the bar to the right in a pair indicating DNMT1. The groups on the x-axis from left to right are mock, an FnCpf1, and GFP-FnCpf1. Shown at the bottom is a table of percent change in efficiency of GFP-FnCpf1 over an FnCpf1, which is indicated as −60% for CCR5 and −90% for DNMT1 for GFP-FnCpf1.

FIG. 120 shows at top a schematic of a construct of the present disclosure, which from left to right includes a His-tag, GFP, an FnCpf1, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, an FnCpf1, and GFP-FnCpf1. Shown at the bottom is a table of percent change in efficiency of GFP-FnCpf1 over FnCpf1, which is indicated as −100% for CCR5 and −100% for DNMT1 for GFP-FnCpf1.

FIG. 121 shows at top a schematic of a construct of the present disclosure, which from left to right includes a His-tag, SSB, an FnCpf1, BPNLS, and a His-tag. Shown in the middle is a bar graph of knock-out efficiency. The y-axis shows indels (%) in increments of 0.2 from 0 to 1.2. The bar graph shows a pair of bars per group with the bar to the left in a pair indicating CCR5 and the bar to the right in a pair indicating DNMT1. The groups on the x-axis from left to right are mock, an FnCpf1, and SSB-FnCpf1. Shown at the bottom is a table of percent change in efficiency of SSB-FnCpf1 over an FnCpf1, which is indicated as −30% for CCR5 and −50% for DNMT1 for SSB-FnCpf1.

FIG. 122 shows at top a schematic of a construct of the present disclosure, which from left to right includes a His-tag, SSB, an FnCpf1, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, an FnCpf1, and SSB-FnCpf1. Shown at the bottom is a table of percent change in efficiency of SSB-FnCpf1 over FnCpf1, which is indicated as −50% for CCR5 and −50% for DNMT1 for SSB-FnCpf1.

FIG. 123 shows at top a schematic of a construct of the present disclosure, which from left to right includes a His-tag, SSB, an FnCpf1, RecJ, BPNLS, and a His-tag. Shown in the middle is a bar graph of knock-out efficiency. The y-axis shows indels (%) in increments of 0.2 from 0 to 1.2. The bar graph shows a pair of bars per group with the bar to the left in a pair indicating CCR5 and the bar to the right in a pair indicating DNMT1. The groups on the x-axis from left to right are mock, an FnCpf1, and SSB-FnCpf1-RecJ. Shown at the bottom is a table of percent change in efficiency of SSB-FnCpf1-RecJ over an FnCpf1, which is indicated as −60% for CCR5 and −70% for DNMT1 for SSB-FnCpf1-RecJ.

FIG. 124 shows at top a schematic of a construct of the present disclosure, which from left to right includes a His-tag, SSB, an FnCpf1, RecJ, BPNLS, and a His-tag. Shown in the middle is a bar graph of knock-in efficiency. The y-axis shows homology directed repair (HDR) (%) in increments of 0.5 from 0 to 4. The bar graph shows a pair of bars per group with the bar to the left in a pair indicating CCR5 and the bar to the right in a pair indicating DNMT1. The groups on the x-axis from left to right are mock, an FnCpf1, and SSB-FnCpf1-RecJ. Shown at the bottom is a table of percent change in efficiency of SSB-FnCpf1-RecJ over FnCpf1, which is indicated as −90% for CCR5 and −90% for DNMT1 for SSB-FnCpf1-RecJ.

FIG. 125 shows at top a schematic of a construct of the present disclosure, which from left to right includes a His-tag, DSB, an FnCpf1, BPNLS, and a His-tag. Shown in the middle is a bar graph of knock-out efficiency. The y-axis shows indels (%) in increments of 0.2 from 0 to 1.6. The bar graph shows a pair of bars per group with the bar to the left in a pair indicating CCR5 and the bar to the right in a pair indicating DNMT1. The groups on the x-axis from left to right are mock, an FnCpf1, and DSB-FnCpf1. Shown at the bottom is a table of percent change in efficiency of DSB-FnCpf1 over an FnCpf1, which is indicated as +200% for CCR5 and −90% for DNMT1 for DSB-FnCpf1.

FIG. 126 shows at the top left a bar graph showing non-homologous end joining efficiency (−ssODN, −nocodazole). The y-axis shows indels (%) in increments of 1 from 0 to 8. The bar graph shows a pair of bars per group with the bar to the left in a pair indicating CCR5 and the bar to the right in a pair indicating DHCR7. The groups on the x-axis from left to right are mock, SpyCas9, SpyCas9-GFP, SpyCas9-hTdT, SpyCas9-RecJ, SpyCas9-RecE, SpyCas9-lambda, SpyCas9-mungbean, and SpyCas9-T5. FIG. 126 shows at the top right a bar graph showing non-homologous end joining efficiency (+ssODN, +nocodazole). The y-axis shows indels (%) in increments of 1 from 0 to 9. The bar graph shows a pair of bars per group with the bar to the left in a pair indicating CCR5 and the bar to the right in a pair indicating DHCR7. The groups on the x-axis from left to right are mock, SpyCas9, SpyCas9-GFP, SpyCas9-hTdT, SpyCas9-RecJ, SpyCas9-RecE, SpyCas9-lambda, SpyCas9-mungbean, and SpyCas9-T5. FIG. 126 shows at bottom a graph showing effects of ssODN and nocodazole. The y-axis shows +ssODN/+nocodazole indels (%) in increments of 1 from 0 to 9 and the x-axis shows −ssODN/− nocodazole indels (%) in increments of 1 from 0 to 9. Shown on the graph is a series of points, which is fit with a line having the equation y=1.1173x+0.135 with an $R^2$ value of 0.9008.

FIG. 127 shows at the top left a bar graph showing non-homologous end joining efficiency (−ssODN, −nocodazole). The y-axis shows indels (%) in increments of 0.5 from 0 to 2.5. The bar graph indicates DHCR7. The groups on the x-axis from left to right are mock, SpyCas9, RecJ-SpyCas9, RecE-SpyCas9, GFP-SpyCas9, SSB-SpyCas9, DSB-SpyCas9, and DSB-SpyCas9-RecJ. FIG. 127 shows at the top right a bar graph showing non-homologous end joining efficiency (+ssODN, +nocodazole). The y-axis shows indels (%) in increments of 0.5 from 0 to 3. The bar graph indicates DHCR7. The groups on the x-axis from left to right are mock, SpyCas9, RecJ-SpyCas9, RecE-SpyCas9, GFP-SpyCas9, SSB-SpyCas9, DSB-SpyCas9, and DSB-SpyCas9-RecJ. FIG. 127 shows at bottom a graph showing effects of ssODN and nocodazole. The y-axis shows +ssODN/+nocodazole indels (%) in increments of 0.5 from 0 to 3 and the x-axis shows −ssODN/−nocodazole indels (%) in increments of 0.5 from 0 to 3. Shown on the graph is a series of points, which is fit with a line having the equation y=1.0255x−0.1253 with an $R^2$ value of 0.4317.

FIG. 128 shows at the top left a bar graph showing non-homologous end joining efficiency (−ssODN, −nocodazole). The y-axis shows indels (%) in increments of 0.5 from 0 to 4.5. The bar graph shows a pair of bars per group with the bar to the left in a pair indicating CCR5 and the bar to the right in a pair indicating DHCR7. The groups on the x-axis from left to right are mock, FnCpf1, FnCpf1-RecJ, FnCpf1-RecE, FnCpf1-hTdT, FnCpf1-T5, FnCpf1-lambda, FnCpf1-mungbean, and FnCpf1-GFP. FIG. 128 shows at the top right a bar graph showing non-homologous end joining efficiency (+ssODN, +nocodazole). The y-axis shows indels (%) in increments of 2 from 0 to 16. The bar graph shows a pair of bars per group with the bar to the left in a pair indicating CCR5 and the bar to the right in a pair indicating DHCR7. The groups on the x-axis from left to right are mock, FnCpf1, FnCpf1-RecJ, FnCpf1-RecE, FnCpf1-hTdT, FnCpf1-T5, FnCpf1-lambda, FnCpf1-mungbean, and FnCpf1-GFP. FIG. 128 shows at bottom a graph showing effects of ssODN and nocodazole. The y-axis shows +ssODN/+nocodazole indels (%) in increments of 2 from 0 to 16 and the x-axis shows −ssODN/−nocodazole indels (%) in increments of 2 from 0 to 16. Shown on the graph is a series of points, which is fit with a line having the equation y=4.033x−0.1724 with an $R^2$ value of 0.8651.

FIG. 129 shows at the top left a bar graph showing non-homologous end joining efficiency (−ssODN, −nocodazole). The y-axis shows indels (%) in increments of 0.2 from 0 to 1.2. The bar graph shows a pair of bars per group with the bar to the left in a pair indicating CCR5 and the bar to the right in a pair indicating DHCR7. The groups on the x-axis from left to right are mock, FnCpf1, RecJ-FnCpf1, GFP-FnCpf1, SSB-FnCpf1, and SSB-FnCpf1-RecJ. FIG. 129 shows at the top right a bar graph showing non-homologous end joining efficiency (+ssODN, +nocodazole). The y-axis shows indels (%) in increments of 2 from 0 to 14. The bar graph shows a pair of bars per group with the bar to the left in a pair indicating CCR5 and the bar to the right in a pair indicating DHCR7. The groups on the x-axis from left to right are mock, FnCpf1, RecJ-FnCpf1, GFP-FnCpf1, SSB-FnCpf1, and SSB-FnCpf1-RecJ. FIG. 129 shows at bottom a graph showing effects of ssODN and nocodazole. The y-axis shows +ssODN/+nocodazole indels (%) in increments of 2 from 0 to 14 and the x-axis shows −ssODN/−nocodazole indels (%) in increments of 2 from 0 to 14. Shown on the graph is a series of points, which is fit with a line having the equation $y=-1.0952x+2.9455$ with an $R^2$ value of 0.0151.

FIG. 130 at left shows off-target effect of CRISPR on CCR5 and at right shows off-target effects of CRISPR on DHCR7. Back highlighted residues indicate mismatches. GFLAS01 was a negative control; GFLAS2, GFLAS3, and GFLAS4 for CCR5 sgRNA treatment; GFLAS05, GFLAS06, and GFLAS07 for DHCR7 treatment—GFLAS02 and GFLAS05 for SpyCas9 at 48 h; GFLAS03, GFLAS06 for Cas9-RecJ at 24 h; GFLAS04, and GFLAS07 for Cas9-RecJ at 48 h. The columns to the left in the CCR5 and DHCR7 images show mismatched residues from a target sequence shown at the top. In the columns to the right in the CCR5 and DHCR7 images show off-target effects. In the CCR5 image: GFLAS02 exhibited non-zero percentages of off-target effects that ranged up to 12.4%, but were predominantly between 2-6%, GFLAS03 exhibited non-zero percentages of off-target effects that range up to 10%, and GFLAS04 exhibited non-zero percentages of off-target effects that ranged up to 6.25%. In the DHCR7 image: GFLAS05 exhibited non-zero percentages of off-target effects that ranged up to 9.81%, GFLAS06 exhibited non-zero percentages of off-target effects that ranged up to 7.14%, and GLFAS07 exhibited non-zero percentages of off-target effects that ranged up to 4.65%.

In some cases, for CCR5: GFLAS05 exhibited non-zero percentages of off-target effects that ranged up to 9.10%, GFLAS06 exhibited non-zero percentages of off-target effects that ranged up to 9.09%, and GLFAS07 exhibited non-zero percentages of off-target effects that ranged up to 6.67%. In some cases, for DHCR7: GFLAS02 exhibited non-zero percentages of off-target effects that ranged up to 8.33%, GFLAS03 exhibited non-zero percentages of off-target effects that ranged up to 9.09%, GFLAS04 exhibited non-zero percentages of off-target effects that ranged up to 6.78%, GFLAS05 exhibited non-zero percentages of off-target effects that ranged up to 15.10%, GFLAS06 exhibited non-zero percentages of off-target effects that ranged up to 7.14%, and GLFAS07 exhibited non-zero percentages of off-target effects that ranged up to 4.65%.

FIG. 131 at top shows a schematic of exon 3 in PFT3, exon 4 in PFT1, and exon 5 in PFT2, The figure in middle shows a gel of FUCT13_1 with lanes from left to right of mock, mock, SpyCas9 at 24, 48, and 72 h, and SpyCas9: RecJ at 24, 48, and 72 h. Uncut and cut products are shown by arrows at 1028 bp and 836 bp. Editing efficiency is shown below as 7, 10, 15, 20, 13, 22, and 23% from the second mock lane onwards.

FIG. 132 shows a timeline showing Zn added at 12 h, cells harvested at 24 h, cells harvested at 48 h, and cells harvested at 60 h.

FIG. 133 shows images of cells in a well plate, In the top row $ZnSO_4$ is 0, 40, 80, and 120 mM. In the bottom row, showing cell death, ZnS)4 is 160 and 200 mM. $1.0\times10^5$ cells were in the 24 well plate.

FIG. 134 shows a gel with lanes from left to right of a ladder; $-ZnSO_4$ (mM) and −RNP, 0 $ZnSO_4$ (mM) and +RNP, 80 $ZnSO_4$ (mM) and +RNP, 160 $ZnSO_4$ (mM) and +RNP, $-ZnSO_4$ (mM) and −RNP, 0 $ZnSO_4$ (mM) and +RNP, 80 $ZnSO_4$ (mM) and +RNP, 160 $ZnSO_4$ (mM) and +RNP, $-ZnSO_4$ (mM) and —RNP, 0 $ZnSO_4$ (mM) and −RNP, 80 $ZnSO_4$ (mM) and +RNP, and 160 $ZnSO_4$ (mM) and +RNP, After the ladder, the first 4 lanes are 12 (Zn) to 24 h (harvest). The next 4 lanes are 12 (Zn) to 36 h (harvest). The next 4 lanes are 12 (Zn) to 60 h (harvest), The substrate and cleaved product are shown, % indels are 2.5, 2.9, 1.8, 3.9, 0.3.5, 2.7, 7.7, 5.4, and 5.8 for the 0, 80, and 160 $ZnSO_4$ concentrations for each group from left to right, FIG. 135 at top shows a gel, which from left to right has lanes of: a DNA ladder; 24 h hours post-transfection (hpt) without RNP, without $ZnSO_4$ at 24 hpt, and without $ZnSO_4$ treatment method; 24 h hpt with RNP, without $ZnSO_4$ at 24 hpt, and without $ZnSO_4$ treatment method; 24 h hpt with RNP, without $ZnSO_4$ at 24 hpt, and without $ZnSO_4$ treatment method; 48 h hpt with RNP, 80 μM $ZnSO_4$ at 24 hpt, and direct; 48 h hpt with RNP, 160 μM $ZnSO_4$ at 24 hpt, and direct; 48 h hpt with RNP, without $ZnSO_4$ at 24 hpt, and without $ZnSO_4$ treatment method; 72 h hpt with RNP, 80 μM $ZnSO_4$ at 24 hpt, and direct; 72 h hpt with RNP, 160 μM $ZnSO_4$ at 24 hpt, and direct; 48 h hpt with RNP, 80 μM $ZnSO_4$ at 24 hpt, and media exchange; 48 h hpt with RNP, 160 μM $ZnSO_4$ at 24 hpt, and media exchange; 72 h hpt with RNP, 80 μM $ZnSO_4$ at 24 hpt, and media exchange; and 72 h hpt with RNP, 160 μM $ZnSO_4$ at 24 hpt, and media exchange, Arrows at right of gel indicates substrate dsDNA at 610 bp and modified dsDNA at 300 bp, Modified dsDNA detected via T7E1 assay as a % from left to right (after the lane with the ladder) is 1.97, 4.75, 12.39, 12.62, 3.68, 5.14, 2.8, 1.87, 9.86, 4.96, 9.32, and 1.41. Bar graphs at the bottom show on the y-axis modified dsDNA detected (%) from 0 to 14 in increments of 2, Groups on the x-axis show 24, 48, 72, 48, and 72 h hpt, For the 24 h group, from left to right bars show non-treated and RNP only, For the 48 h group, from left to right, bars show RNP only, RNP+80 μM $ZnSO_4$, and RNP+160 μM $ZnSO_4$. For the 72 h group, from left to right, bars show RNP only RNP+80 μM $ZnSO_4$, and RNP+160 μM $ZnSO_4$. Additional bars for RNP+80 μM $ZnSO_4$ and RNP+160 μM $ZnSO_4$ are shown to the right for 48 h and 72 h hpt.

FIG. 136 shows at top a graph of indel frequency percentage (%) on the y-axis from 0 to 20 in increments of 5 and groups on the x-axis including control (con), Cas9, Cas9, Cas9, Cas9-RecJ, Cas9-RecJ, and Cas9-RecJ for FucT13_1 PFT3. At bottom, the figure shows a graph of indel frequency percentage (%) on the y-axis from 0 to 20 in increments of 5 and groups on the x-axis including control (con), Cas9, Cas9, Cas9-RecJ, and Cas9-RecJ for FucT13_1 PFT1.

FIG. 137 shows a gel. The middle lane is the ladder and the 5 lanes to the left and right are samples. At the top of the gel is the amount of SSB-SpyCas9 in sample lanes, which from left to right is −, 1, 2, 3, 4 ug to the left of the ladder and is −, 1, 2, 3, 4 ug to the right of the ladder. The next row is the amount of ssODN in all sample lanes, which is shown to be 2.5 ug. Within the gel, the 200 bp and 100 bp bands are marked on the ladder. To the left is 30 nt and to the right is 130 nt. The 30 nt band is marked to the left and the 130 nt band is marked to the right. ssODN intensity (%) from left to right for sample lanes is 100, 105, 88, 92, 70, 100, 96, 99, 77, and 68.

FIG. 138 shows a gel with a ladder in the left most lane and the 300 and 200 bp bands marked to the left. The next five lanes are experimental lanes. The amount of DSB-SpyCas9 is at the top of the gel and for experimental lanes from left to right is −, 7 μg, 700 ng, 70 ng, and 7 ng. Underneath is the amount of dsDNA used in all experimental lanes, which is indicated as 50 ng for every sample. Underneath is a graphic showing increased concentration of protein was used right to left in experimental lanes.

FIG. 139 shows a graph of knock-out efficiency (+dsDNA/+Nocadazole) at left. The graph on the y-axis shows indels (%) from 0 to 80 increments of 10 and the x-axis shows the groups including SpyCas9, DSB-Spy Cas9, and DSB-SpyCas9-RecJ. Within each group, there are a pair of bars—the left bar in the pair depicts CR5 and the right bar in the pair depicts DHCR7. At right is a graph of knock-in efficiency (+dsDNA/+Nocadazole). The graph on the y-axis shows HDR (%) from 0 to 80 increments of 10 and the x-axis shows the groups including SpyCas9, DSB-Spy Cas9, and DSB-SpyCas9-RecJ. Within each group, there are a pair of bars—the left bar in the pair depicts CR5 and the right bar in the pair depicts DHCR7.

FIG. 140 shows at top a schematic of a construct of the present disclosure, which from left to right includes a His-tag, DSB, SpyCas9, BPNLS, and a His-tag. Shown in the middle is a bar graph of knock-out efficiency (+dsDNA/+Nocadazole). The y-axis shows indels (%) in increments of 10 from 0 to 80 The groups on the x-axis from left to right are SpyCas9 and DSB-SpyCas9. Shown at the bottom is a table of percent change in efficiency of DSB-SpyCas9 over SpyCas9, which is indicated as +140% for CCR5.

FIG. 141 shows at top a schematic of a construct of the present disclosure, which from left to right includes a His-tag, DSB, SpyCas9, BPNLS, and a His-tag. Shown in the middle is a bar graph of knock-in efficiency. The y-axis shows HDR (%) in increments of 10 from 0 to 80. The groups on the x-axis from left to right are SpyCas9 and DSB-SpyCas9. Shown at the bottom is a table of percent change in efficiency of DSB-SpyCas9 over SpyCas9, which is indicated as +190% for CCR5.

Numbered Embodiments

The following embodiments recite non-limiting permutations of combinations of features disclosed herein. Other permutations of combinations of features are also contemplated. In particular, each of these numbered embodiments is contemplated as depending from or relating to every previous or subsequent numbered embodiment, independent of their order as listed. 1. A polypeptide comprising a sequence specific endonuclease fused in frame to a DNA modifying enzyme (DME), wherein the polypeptide exhibits enhanced on target mutagenesis compared to the sequence specific endonuclease and wherein the peptide exhibits the same or lower off target mutagenesis compared to the sequence specific endonuclease when unfused. 2. The polypeptide of embodiment 1, wherein the DNA modifying enzyme comprises a RecE domain. 3. The polypeptide of embodiment 2, wherein the RecE domain exhibits at least 70% identity over at least 70% of its sequence to RecE. 4. The polypeptide of embodiment 3, wherein the RecE domain exhibits at least 90% identity to RecE. 5. The polypeptide of embodiment 2, wherein the RecE domain comprises a RecE sequence. 6. The polypeptide of embodiment 1, wherein the DNA modifying enzyme comprises a RecJ domain. 7. The polypeptide of embodiment 6, wherein the RecJ domain exhibits at least 70% identity over at least 70% of its sequence to RecJ. 8. The polypeptide of embodiment 7, wherein the RecJ domain exhibits at least 90% identity to RecJ. 9. The polypeptide of embodiment 6, wherein the RecJ domain comprises a RecJ sequence. 10. The polypeptide of embodiment 1, wherein the DNA modifying enzyme comprises a RecBCD domain. 11. The polypeptide of embodiment 10, wherein the RecBCD domain exhibits at least 70% identity over at least 70% of its sequence to RecBCD. 12. The polypeptide of embodiment 11, wherein the RecBCD domain exhibits at least 90% identity to RecBCD. 13. The polypeptide of embodiment 10, wherein the RecBCD domain comprises a RecBCD sequence. 14. The polypeptide of embodiment 1, wherein the DNA modifying enzyme comprises a Mungbean nuclease domain. 15. The polypeptide of embodiment 6, wherein the Mungbean nuclease domain exhibits at least 70% identity over at least 70% of its sequence to Mungbean nuclease. 16. The polypeptide of embodiment 7, wherein the Mungbean nuclease domain exhibits at least 90% identity to Mungbean nuclease. 17. The polypeptide of embodiment 7, wherein the Mungbean nuclease domain comprises a Mungbean nuclease sequence. 18. The polypeptide of embodiment 1, wherein the DNA modifying enzyme comprises an ExoI domain. 19. The polypeptide of embodiment 18, wherein the ExoI domain exhibits at least 70% identity over at least 70% of its sequence to ExoI. 20. The polypeptide of embodiment 19, wherein the ExoI domain exhibits at least 90% identity to ExoI. 21. The polypeptide of embodiment 18, wherein the ExoI domain comprises an ExoI sequence. 22. The polypeptide of embodiment 1, wherein the DNA modifying enzyme comprises an ExoIII domain. 23. The polypeptide of embodiment 22, wherein the ExoIII domain exhibits at least 70% identity over at least 70% of its sequence to ExoIII. 24. The polypeptide of embodiment 23, wherein the ExoIII domain exhibits at least 90% identity to ExoIII. 25. The polypeptide of embodiment 22, wherein the ExoIII domain comprises an ExoIII sequence. 26. The polypeptide of embodiment 1, wherein the DNA modifying enzyme comprises an ExoVII domain. 27. The polypeptide of embodiment 26, wherein the ExoVII domain exhibits at least 70% identity over at least 70% of its sequence to ExoVII. 28. The polypeptide of embodiment 27, wherein the ExoVII domain exhibits at least 90% identity to ExoVII. 29. The polypeptide of embodiment 26, wherein the ExoVII domain comprises an ExoVII sequence. 30. A polypeptide comprising a sequence-specific endonuclease fused in frame to a DNA binding protein (DBP). 31. The polypeptide of embodiment 30, wherein the DBP binds single-stranded DNA. 32. The polypeptide of embodiment 30, wherein the DBP binds double-stranded DNA. 33. A polypeptide comprising a sequence-specific endonuclease fused in frame to a terminal deoxyribonucleotidyl transferase (TdT). 34. The polypeptide of any one of embodiments 1-33, wherein the sequence-specific endonuclease comprises a region exhibiting 70% identity over at least 70% of its residues to a Cas9 domain. 35. The polypeptide of embodiment 34, exhibiting at least 90% identity to a Cas9 domain. 36. The polypeptide of embodiment 34, wherein the region is a Cas9 domain. 37. The polypeptide of embodiment 34, wherein the Cas9 is SpCas9. 38. The polypeptide of any one of embodiments 1-33, wherein the sequence-specific endonuclease comprises a region exhibiting 70% identity over at least 70% of its residues to a Cpf1 domain. 39. The polypeptide of embodiment 37, exhibiting at least 90% identity to a Cpf1 domain. 40. The polypeptide of embodiment 37, wherein the region is a Cpf1 domain. 41. The polypeptide of any one of embodiments 1-33, wherein the sequence-specific endonuclease comprises a TALEN nucleic acid recognition site. 42. The polypeptide of any one of embodiments 1-33, wherein the sequence-specific endonuclease comprises a zinc finger nucleic acid recognition site. 43. The polypeptide of any one of embodiments 1-42, comprising a nuclear localization signal. 44. The polypeptide of any one of embodiments 1-42, comprising an affinity tag. 45. The polypeptide of any one of embodiments 1-29, wherein the DNA modifying enzyme generates a 3' OH overhang. 46. The polypeptide of any one of embodiments 1-29, wherein the DNA modifying enzyme exposes a recessed 3' OH. 47. The polypeptide of any one of embodiments 1-29, wherein the DNA modifying enzyme comprises cleaved end resection activity. 48. The polypeptide of any one of embodiments 1-29, wherein the polypeptide concurrently exhibits increased mutation efficiency and increased homologous recombination efficiency relative to wild type Cas9. 49. The polypeptide of embodiment 48, wherein the increased activity is measured in at least one human cell genome or plant cell genome. 50. The polypeptide of embodiment 49, wherein the measured activity is assessed following a 2 hour incubation. 51. The polypeptide of embodiment 49, wherein the measured activity is assessed following a 24 hour incubation. 52. The polypeptide of embodiment 48, wherein the increased activity comprises an increased deletion rate. 53. The polypeptide of embodiment 48, wherein the increased activity comprises an increased insertion rate. 54. The polypeptide of embodiment 48, wherein the increased activity comprises an increased homologous recombination rate. 55. The polypeptide of any one of embodiments 1-54, wherein the polypeptide is substantially free of bacterial cellular contaminant. 56. The polypeptide of any one of embodiments 1-54, wherein the polypeptide does not have an animal glycosylation pattern. 57. The polypeptide of any one of embodiments 1-54, wherein the polypeptide does not have a bacterial glycosylation pattern. 58. The polypeptide of any one of embodiments 1-54, wherein the polypeptide does not have a fungal glycosylation pattern. 59. The polypeptide of any one of embodiments 1-54, wherein the polypeptide is incubated in contact with a genome at a pH of at least 6. 60. The polypeptide of any one of embodiments 1-54, wherein the polypeptide is incubated in contact with a genome at a pH of at least 10. 61. The polypeptide of any one of embodiments 1-60, wherein the enhanced on target mutagenesis is 1% greater, 2% greater, 3% greater, 4% greater, 5% greater, 10% greater, 15%, greater, 20% greater, 25% greater, 30% greater, 35% greater, 40% greater, 45% greater, 50% greater, 55% greater, 60% greater, 65% greater, 70% greater, 75% greater, 80% greater, 85% greater, or 90% greater compared to on target mutagenesis of the sequence specific endonuclease. 62. A nucleic acid encoding a chimeric polypeptide of any one of embodiments 1-60. 63. The nucleic acid of embodiment 61, comprising an open reading frame that is at least partially codon optimized for expression in a plant target organism. 64. The nucleic acid of embodiment 61, comprising an open reading frame that is at least partially codon optimized for expression in a bacterial target organism. 65. The nucleic acid of embodiment 61, comprising an open reading frame that is at least partially codon optimized for expression in an animal target organism. 66. The nucleic acid of embodiment 61, comprising an open reading frame that is at least partially codon optimized for expression in a mammalian target organism. 67. The nucleic acid of embodiment 61, comprising an open reading frame that is at least partially codon optimized for expression in a human cell. 68. The nucleic acid of embodiment 61, comprising a 5' UTR at least partially optimized for expression in a plant target organism. 69. The nucleic acid of embodiment 61, comprising a 3' UTR at least partially optimized for expression in a plant target organism. 70. The nucleic acid of embodiment 61, comprising a 5' UTR at least partially optimized for expression in a bacterial target organism. 71. The nucleic acid of embodiment 61, comprising a 3' UTR at least partially optimized for expression in a bacterial target organism. 72. The nucleic acid of embodiment 61, comprising a 5' UTR at least partially optimized for expression in an animal target organism. 73. The nucleic acid of embodiment 61, comprising a 3' UTR at least partially optimized for expression in an animal target organism. 74. The nucleic acid of embodiment 61, comprising a 5' UTR at least partially optimized for expression in a mammalian target organism. 75. The nucleic acid of embodiment 61, comprising a 3' UTR at least partially optimized for expression in a mammalian target organism. 76. The nucleic acid of embodiment 61, configured for transient expression in a plant cell. 77. The nucleic acid of embodiment 61, coated on at least one gold particle. 78. The nucleic acid of embodiment 61, coated on at least one tungsten particle. 79. The nucleic acid of embodiment 61, packaged into a viral expression vector. 80. The nucleic acid of embodiment 61, configured for stable expression in a plant cell. 81. The nucleic acid of embodiment 61, configured for *Agrobacterium* expression. 82. The nucleic acid of embodiment 80, packaged into a bacterial transformation vector. 83. The nucleic acid of embodiment 80, packaged into a viral transformation vector. 84. The nucleic acid of embodiment 80, packaged into a transformation vector for nuclear transformation. 85. The nucleic acid of embodiment 80, packaged into a transformation vector for organellar transformation. 86. The nucleic acid of embodiment 61, comprising a plant viral promoter. 87. The nucleic acid of embodiment 61, comprising a 35S promoter. 88. The nucleic acid of embodiment 61, comprising an rbcS promoter. 89. The nucleic acid of embodiment 61, comprising a psbA promoter. 90. The nucleic acid of embodiment 61, comprising an ubiquitin promoter. 91. A method of tagging a repaired chromosome, comprising contacting the chromosome to a composition comprising a polypeptide of any one of embodiments 1-60, wherein the polypeptide comprises a terminal deoxyribonucleotidyl transferase (TdT) activity, and a labeled nucleic acid. 92. The method of embodiment 91, wherein the labeled nucleic acid comprises a non-canonical base. 93. The method of embodiment 92, wherein the non-canonical base comprises BrdU. 94. The method of embodiment 93, comprising isolating nucleic acids comprising the labeled nucleic acid. 95. A method of concurrently increasing a CRISPR-directed mutation rate and homologous recombination rate, comprising contacting a chromosome to a composition comprising a polypeptide of any one of embodiments 1-60, wherein the polypeptide yields an exposed 3' OH overhang at a cleavage site of the chromosome. 96. The method of embodiment 95, comprising contacting the chromosome to a 5'-3' exonuclease activity. 97. The method of embodiment 95, wherein the method exhibits at least a 20% genome modification rate. 98. The method of embodiment 95, wherein the contacting occurs at a pH of at least 6. 99. The method of embodiment 95, wherein the contacting occurs at a pH of at least 10. 100. A method of modifying a plant genome, comprising transfecting a cell harboring the plant genome using a polypeptide of any one of embodiments 1-60, culturing the cell, and recovering plant tissue comprising a modified plant genome. 101. The method of embodiment 100, wherein the modified plant genome does not encode a protein glycosyl transferase. 102. A method of modifying a plant genome, comprising transfecting a cell harboring the plant genome using a nucleic acid of any one of embodiments 61-90, culturing the cell, and recovering plant tissue comprising a modified plant genome. 103. The method of embodiment 102, wherein the modified plant genome does not encode a protein glycosyl transferase. 104. A composition comprising a polypeptide having endonuclease activity, a mung bean nuclease domain and a DNA sequence specificity domain. 105. A method of targeting a single locus for mutagenesis, said method comprising selecting a locus for mutagenesis, contacting a genomic sample comprising the locus to an enzyme comprising an exonuclease domain and a programmable endonuclease domain that binds to the locus, sequencing across the locus, and sequencing a substantial portion of the genomic sample aside from the locus. 106. The method of embodiment 105, wherein said selecting comprises identifying a unique segment of at least 10 bases in the genomic sample. 107. The method of embodiment 105, wherein said contacting occurs in vivo. 108. The method of embodiment 107, wherein said contacting comprises transfecting a cell using a vector encoding the enzyme. 109. The method of embodiment 107, wherein said contacting comprises bombarding a cell using a nucleic acid encoding the enzyme. 110. The method of embodiment 109, wherein bombarding comprises contacting to at least one gold particle. 111. The method of embodiment 109, wherein bombarding comprises contacting to at least one tungsten particle. 112. The method of embodiment 107, wherein said contacting comprises vacuum infiltration. 113. The method of embodiment 107, wherein said contacting comprises *Agrobacterium*-mediated transformation. 114. The method of embodiment 107, wherein said contacting comprises stable transformation. 115. The method of embodiment 107, wherein said contacting comprises transient expression. 116. The method of embodiment 105, wherein said exonuclease domain comprises an ExoI exonuclease activity. 117. The method of embodiment 105, wherein said exonuclease domain comprises 5'-3' overhang exonuclease activity. 118. The method of embodiment 105, wherein said exonuclease domain comprises double-stranded nucleic acid exonuclease activity. 119. The method of embodiment 105, wherein said exonuclease domain does not exhibit single stranded nucleic acid exonuclease activity. 120. The method of embodiment 105, wherein sequencing across the locus comprises observing a mutation relative to the locus prior to contacting. 121. The method of embodiment 105, wherein sequencing across the locus comprises observing a deletion relative to the locus prior to contacting. 122. The method of embodiment 105, wherein sequencing a substantial portion of the genomic sample aside from the locus comprises sequencing at least 1% of a genome copy of the genomic sample. 123. The method of embodiment 105, wherein sequencing a substantial portion of the genomic sample aside from the locus comprises sequencing at least 5% of a genome copy of the genomic sample. 124. The method of embodiment 105, wherein sequencing a substantial portion of the genomic sample aside from the locus comprises sequencing at least 10% of a genome copy of the genomic sample. 125. The method of embodiment 105, wherein sequencing a substantial portion of the genomic sample aside from the locus comprises sequencing at least 50% of a genome copy of the genomic sample. 126. The method of any one of embodiments 122-125, wherein said contacting occurs in vivo, and wherein said sequencing a substantial portion of the genomic sample aside from the locus is performed subsequent to at least one cell division subsequent to said contacting. 127. The method of embodiment 105, comprising contacting the sample to a Zinc ion. 128. The method of embodiment 105, comprising contacting the sample to a composition comprising Zinc sulfate. 129. A method of targeting a single locus for mutagenesis, said method comprising selecting a locus for mutagenesis, contacting a genomic sample comprising the locus to DNA binding protein (DBP) and a programmable endonuclease domain that binds to the locus, sequencing across the locus, and sequencing a substantial portion of the genomic sample aside from the locus. 130. The method of embodiment 129, wherein the DBP binds single-stranded DNA. 131. The method of embodiment 129, wherein the DBP binds double-stranded DNA. 132. The method of embodiment 129, wherein the DBP comprises a single stranded DNA binding protein (SSB). 133. The method of embodiment 129, wherein the DBP and the programmable endonuclease are fused in frame and transfected in cells in vivo. 134. The method of embodiment 129, wherein the mutagenesis comprises homology directed repair (HDR). 135. The method of embodiment 129, wherein the mutagenesis increases the efficiency of HDR.

EXAMPLES

Further understanding of the disclosure herein is gained through reference to the following embodiments.

Example 1: Linear DNA Cleavage with Cas9-RecE

Linear dsDNA A (514 bp) and linear dsDNA B (317 bp) were cleaved with SpCas9 and SpCas9-RecE. FIG. 6 illustrates results of the cleavage. sgRNA A and sgRNA B were used as guide RNA for dsDNA A and ds DNA B, respectively. A control reaction was also performed, referred to as mock in FIG. 6, without gRNA/Cas enzyme. Two versions of SpCas9-RecE were tested: SpCas9-RecE v1 was 1-week old protein and SpCas9-RecE v2 was fresh protein.

Example 2: Circular DNA Cleavage with Cas9-RecE

Circular dsDNA was cleaved with SpCas9 and SpCas9-RecE. FIG. 7 illustrates results of the cleavage. Plasmid dsDNA C was used as circular dsDNA template. sgRNA C was used to guide Cas9 into target site before PAM. SpCas9 and SpCas9-RecE converted circular dsDNA to linear dsDNA by producing double stranded breaks on circular dsDNA. Arrows in FIG. 7 indicate different structure types of the same dsDNA.

Example 3: Use of a Chimeric Polypeptide Comprising RecE to Increase Mutagenic Efficiency of Cas9

DNA was treated with SpCas9 or SpCas9-RecE for 1 hour. After 1 hour, the resulting cleaved DNA was treated with mungbean exonuclease and subjected to DNA electrophoresis for 40 mins. Next, the single linear DNA was eluted, cleaned-up, and ligated. Cleavage sites of 32 colonies were determined and aligned as shown in FIG. 8. FIG. 8A illustrates results obtained for SpCas9. FIG. 8B illustrates results obtained for SpCas9-RecE. For SpCas9, one 6-nt deletion was detected. For SpCas9-RecE, one 3-nt, one 6-nt, and two 15-nt deletion cleaved sequences were detected.

Thus, this example illustrated that a chimeric polypeptide of the disclosure resulted in an increase in the mutagenic efficiency of a site-specific endonuclease in a chimeric polypeptide of the disclosure relative to the wild-type version.

Example 4: Use of a Chimeric Polypeptide Comprising RecE to Increase Mutagenic Efficiency of Cas9

DNA was treated with SpCas9 or SpCas9-RecE for 3 hours. After 3 hours, the resulting cleaved DNA was treated with mungbean exonuclease and subjected to DNA electrophoresis for 40 mins. Next, the single linear DNA was eluted, cleaned-up, and ligated. Cleavage sites of 80 colonies were determined and aligned as shown in FIG. 9. FIG. 9A illustrates results obtained for SpCas9. FIG. 9B illustrates results obtained for SpCas9-RecE. For SpCas9, average 8-nt deletion was detected in 72 colonies, which had edited sequences among 80 colonies. For SpCas9-RecE, approximately 17-nt deletion sequences were detected in 68 colonies, which had edited sequences among 80 colonies.

Thus, this example also illustrated that a chimeric polypeptide of the disclosure resulted in an increase in the mutagenic efficiency of a site-specific endonuclease in a chimeric polypeptide of the disclosure relative to the wild-type version.

Example 5: Use of a Chimeric Polypeptide Comprising RecE to Increase Mutagenic Efficiency of Cas9

DNA was treated with SpCas9 or SpCas9-RecE for 2 hours. After 2 hours, the resulting cleaved DNA was treated with T4 DNA polymerase treatment, which filled up the single-stranded DNA ends, and subjected to DNA electrophoresis for 40 mins. Next, the single linear DNA was eluted, cleaned-up, and ligated. Cleavage sites of 32 colonies were determined and aligned as shown in FIG. 10. FIG. 10 upper panel illustrates results obtained for SpCas9. FIG. 10 lower panel illustrates results obtained for SpCas9-RecE. For SpCas9, average 6-nt deletion was detected. For SpCas9-RecE, approximately 20-nt deletion sequences were detected.

Thus, this example also illustrated that a chimeric polypeptide of the disclosure resulted in an increase in the mutagenic efficiency of a site-specific endonuclease in a chimeric polypeptide of the disclosure relative to the wild-type version.

Example 6: Use of a Chimeric Polypeptide Comprising RecE to Increase Mutagenic Efficiency of Cas9

FIG. 11 shows a box-plot illustrating increase in mutagenic efficiency of Cas9 when fused to RecE. Left panel was treated by mungbean treatment after DNA cleavage, right panel was treated by T4 DNA polymerase after DNA cleavage. The difference between edited lines and control non-edited lines was evaluated by Students T test. Standard deviations (SD) are provided as appropriate.

Example 7: In Vitro Cleavage Assay to Evaluate Mutagenic Efficiency of Cas9

FIG. 7A illustrates a schematic diagram for an in vitro cleavage assay. Circular dsDNA was treated for 3 hours with SpCas9 or SpCas9-RecE. The cleaved dsDNA was treated with Q5 DNA polymerase treatment, which filled up the single stranded DNA of dsDNA, and then subjected to DNA electrophoresis for 40 min. The single linear DNA was eluted, cleaned-up, and ligated. Colonies produced from the ligated DNA were amplified with M13F/M13R primer pairs, which were used for sequencing the PCR products. Products of the colony PCT were treated with XcmI for 1 hour at 37° C. If the circular dsDNA was untouched by SpCas9/SpCas9-RecE or repaired by Q5 polymerase, the PCR products would be digested by XcmI. FIG. 7B illustrates DNA electrophoresis results of the assay. For SpCas9 based colonies, the PCR products were not digested by XcmI in 7 out of 30 colonies. For SpCas9-RecE based colonies, the cleavage site was not digested in 14 out of 27 colonies. The products by XcmI were incubated at 37° C. for 1 h. Arrows at the bottom of the gels are uncut colonies by XcmI.

Thus, this example also illustrated that a chimeric polypeptide of the disclosure resulted in an increase in the mutagenic efficiency of a site-specific endonuclease in a chimeric polypeptide of the disclosure relative to the wild-type version.

Example 8: Circular DNA Cleavage with Cas9-RecJ

Circular dsDNA was cleaved with SpCas9 and SpCas9-RecJ. FIG. 13 illustrates results of the cleavage. Plasmid dsDNA C was used as circular dsDNA template. sgRNA C was used to guide Cas9 into target site before PAM. SpCas9 and SpCas9-RecJ converted circular dsDNA to linear dsDNA by producing double stranded breaks on circular dsDNA. Linear dsDNA showed sharp and thick dsDNA size in DNA electrophoresis. SpCas9 produced single sharp and thick dsDNA sizes without time dependency, while SpCas9-RecJ showed blur, weak, thin, and tailed dsDNA, which indicate DNA degradation, after 60-180 min incubations.

Example 9: Time Course of Gene Editing Efficiency

Three Cas9 variants: from Toolgen lacking RecJ, in house source lacking RecJ; Cas9 fused to RecJ, and a guide RNA against loci of human DHCR7 were transfected into HEK293 cells using lipid mediated transfection method. Cells were harvested at different time points, from 0 hours, as a control, to 72 hours, for genomic DNA extraction. FIG. 14 illustrates results of the experiment. In order to improve discriminability of cut DNA band, alternative PCR primer pair was used and that resulted in clearer single band whose size is nearly 300 bp, which was the product of T7E1 endonuclease activity and therefore measured to compare % indel. FIG. 14 clearly shows that Cas9-RecJ was more efficient than Cas9 lacking RecJ.

Example 10: Circular DNA Cleavage with Cas9-T5 Exo

Circular dsDNA was cleaved with SpCas9 and SpCas9-T5 Exonuclease. FIG. 15 illustrates results of the cleavage.

Plasmid dsDNA C was used as circular dsDNA template. sgRNA C was used to guide Cas9 into target site before PAM. Upon cleavage, the circular dsDNA is converted to linear dsDNA by producing double stranded breaks on circular dsDNA. Arrows indicate different structure types of the same dsDNAs.

Example 11: Use of a Chimeric Polypeptide Comprising T5 Exonuclease to Increase Mutagenic Efficiency of Cas9

DNA was treated with SpCas9 or SpCas9-T5 Exo for 3 hours. After 3 hours, the resulting cleaved DNA was treated with Q5 DNA polymerase treatment, which filled up the single-stranded DNA ends, and subjected to DNA electrophoresis for 40 mins. Next, the single linear DNA was eluted, cleaned-up, and ligated. Cleavage sites of 19 colonies were determined and aligned as shown in FIG. 16. FIG. 16 upper panel illustrates results obtained for SpCas9. FIG. 16 lower panel illustrates results obtained for SpCas9-T5 Exo. For SpCas9, no deletion was detected. For SpCas9-T5 Exo, one 1-nt, one 2-nt, and one 19-nt deletions were detected.

Thus, this example illustrated that a chimeric polypeptide of the disclosure resulted in an increase in the mutagenic efficiency of a site-specific endonuclease in a chimeric polypeptide of the disclosure relative to the wild-type version.

Example 12: pH Range Scanning for Cas9

Activity of SpCas9 was determined at various pHs as shown in FIG. 17. The table in the lower panel shows conditions used to conduct the activity assay. The results showed that SpCas9 is active at higher pHs such as pH 10. In an application of in vitro DNA cloning experiment, changing pH conditions could result in inactivation or re-activation of the reaction.

Example 13: Zn Ion Abolishes Cas9 Function

Activity of SpCas9 and SpCas9-mungbean nuclease chimeric polypeptide was tested in the presence of 1 mM $ZnSO_4$ at a range of pHs. FIG. 18 illustrates results of the assay. The table in the lower panel shows conditions used to conduct the activity assay. As shown in FIG. 18, presence of Zn ion completely abolished Cas9 activity. Thus, Zn ions can be used to reduce off-target effect by adding it to abolish Cas9 activity after a desired degree of modification is achieved.

Example 14: Plant Genome Modification

A cell harboring a plant genome is transfected with a chimeric polypeptide of the disclosure. The cell is cultured. The chimeric polypeptide modifies the plant genome. The cell harboring the modified plant genome is recovered.

A cell harboring a plant genome is transfected with a chimeric polypeptide of the disclosure. The cell is cultured. The chimeric polypeptide modifies the plant genome. The cell harboring the modified plant genome is recovered.

Example 15: SpCas9 Activity Under Different pH Ranges, $Mg^{2+}$ Deficiency, and 1 mM $ZnSO_4$ Under $Mg^{2+}$ deficiency, SpCas9 lost its activity, as shown in FIG. 19. When 1 mM $ZnSO_4$ was added, SpCas9 activity was recovered at less than 10% at pH 10 for 1 h in the absence of $Mg^{2+}$.

Example 16: In-Vitro Cleavage Assay of SpCas9 and SpCas9-RecJ in HEK293 Cells to Test Gene Editing Efficiency Cas9 and Cas9-RecJ apoproteins directed against the same loci of human PD-1 and CCR5 were transfected to HEK293 cells using lipid-mediated transfection. Cells were harvested at different time points, from 0 hours, as a control, to 48 hours, followed genomic DNA extraction. PCR was performed to generate 544 bp for CCR5 and 524 bp for PD-1. T7E1 endonuclease assay allowed for the generation of two 274 and 271 bps small fragments of CCR5, and PD-1 produced two 319 and 205 bps small fragments, which were used to measure indel efficiency, as shown in FIG. 20A.

FIG. 20B shows the amplification of five off-targeting genes of human CCR5 sgRNA. The following fragments were observed: ADCY5, 641 bps; KCNJ6, 566 bps; CNTPNA2, 300 bps; Chr.5, 605 bps.

FIG. 20C shows results of an in vitro cleavage assay for five off-targeted genes. Expected cut DNA sizes were 377 and 264 bps for ADCY5; 352 and 214 bps for KCNJ6; 183 and 117 bps for CNTPNA2; 355 and 250 bps for Ch.5. Cleavage products in this case were not sufficiently distinct to allow verification of off-target effects. However, this is specific to this particular substrate rather than being a general trait of the enzyme. Based on the in-vitro assay, the off-target effect for SpCas9-RecJ was not different compared to that of SpCas9.

Example 17: pH Range Scanning for FnCpf1

FIG. 21 shows FnCpf1 activity under different pH ranges. FnCpf1 protein activity was scanned under conditions of pH ranging from pH 3 to pH 10. FnCpf1 showed activity from pH 6 to pH 10. FnCpf1 exhibited the greatest activity at pH 7 for 1 h.

Example 18: In Vitro Cleavage Assay of Linear dsDNA with FnCpf1, FnCpf1-RecJ, SpCas9 Exonuclease FIG. 22 shows linear dsDNA cleavage by FnCpf1, FnCpf1-RecJ, or SpCas9. Linear dsDNA was amplified from plasmid via polymerase chain reaction (PCR) and column purified. Cas9 sgRNA and Cpf1 sgRNA sites were adjacent to each other. The sgRNA was used to guide SpCas9 or FnCpf1 proteins to designated target sites that were located upstream of 5'-NGG-3' and downstream of 5'-TTTN-3' protospacer adjacent motif (PAM), respectively. The intact linear dsDNA before cutting was clearly observed as a single band at around 1200 bp region. The band was cut into two 600 bp bands. However, with FnCpf1-RecJ, the cut bands disappeared as a result of exonuclease activity of RecJ.

Example 19: In Vitro Cleavage Assay of Linear dsDNA with FnCpf1 or FnCpf1-RecJ Exonuclease FIG. 23 shows linear dsDNA cleavage by FnCpf1 or FnCpf1-RecJ. Linear dsDNA was amplified from plasmid via polymerase chain reaction (PCR) and column purified. The sgRNA was used to guide FnCpf1 proteins to designated target sites that were located downstream of 5'-TTTN-3' protospacer adjacent motif (PAM). The intact linear dsDNA before cutting was clearly observed as a single band at around 1200 bp region. The band was designed to cut into two 600 bp bands. With increasing incubation periods, the original bands disappeared in both FnCpf1 and FnCpf1-

RecJ reaction mixtures. However, with FnCpf1-RecJ, the cut bands disappeared as a result of the exonuclease activity of RecJ.

Example 20: In Vitro Cleavage Assay of SpyCas9 and FnCpf1 Proteins Fusion Proteins SpyCas9. For RNP complex, each SpyCas9 and its fusion proteins (25 nM) at 5' or 3'-terminus were mixed with sgRNA (30 nM) targeting for human CCR5 for 20 minutes. NEB3.1 buffer was used. 200 ng of CCR5 template was then added to RNP complex. The mixture was incubated for 1 hour at 37° C. DNA was analyzed by agarose gel electrophoresis and analyzed by ImageJ program. Cleavage efficiency was calculated based on 'Control A'.

FnCpf1. For RNP complex, each FnCpf1 and its fusion proteins (50 nM) at 5' or 3'-terminus were mixed with crRNA (60 nM) targeting for human CCR5 for 20 minutes. NEB1.1 buffer was used. 200 ng of CCR5 template was then added to RNP complex. The mixture was incubated for 2 hours at 37° C. DNA was analyzed by agarose gel electrophoresis and analyzed by ImageJ program. Cleavage efficiency is calculated based on 'Control A'.

and mungbean. Shown at the top is a gel and shown below is a bar graph showing percent cleavage efficiency for each group. FIG. 73 illustrates in vitro cleavage assay of FnCpf1 and fusion proteins at N- or N, C both termini of FnCpf1 against human CCR5. The concentration of each RNP is 50 nM. 'Control A' contains only FnCpf1 protein. Fusion proteins of FnCpf1 don't disturb FnCpf1 activity significantly except GFP, DSB, and SSB-FnCpf1-RecJ. Shown at the top is a gel and shown below is a bar graph showing percent cleavage efficiency for each group.

Example 21: In Vivo Transfection and Deep Sequencing Analysis of On-Target Sites Cell culture. HEK293T cells were cultured in Dulbecco's modified Eagle's medium (DMEM) supplemented with 10% fetal bovine serum, penicillin, and streptomycin.

Cell cycle synchronization. For CRISPR PLUS-mediated knockout, no nocodazole treatment cells were used. For improving efficiency of knock-in, HEK293T cells were seeded at $3 \times 10^6$ cell density in 10-cm culture dish. The cells were treated with nocodazole (200 ng/ml) for 16 hours before electroporation. ssODN templates for knock-in (table) are listed below.

TABLE 5

| Proteins | Genes | ssODN donor sequences (5'-3') |
|---|---|---|
| SpyCas9 | CCR5 | TGGAACAAGATGGATTATCAAGTGTCAAGTCCAATCTATGACAT CAATTATTAT ACATATGCATCGGAGCCCTGCCAAAAAATCAATGTGAAGCAAA TCGCAGCCC (SEQ ID NO: 79) |
| | DHCR7 | ATGGGCCCCAGTGTGACTGCCTGCATCCGTCCTCGCAGGGAGG TGGACTGGT TTTGAATTCCACTGGCGAGCGTCATCTTCCTACTGCTGTTCGCC CCCTTCATCG (SEQ ID NO: 80) |
| FnCpf1 | CCR5 | AATTCTCTGAGGCTTTCTTTTAAATATACATAAGGAACTTTCGG AGTGAAGGG AGAGTTTCATATGGTCAATAACTTGATGCATGTGAAGGGAGAT AAAAAGGTT (SEQ ID NO: 81) |
| | DNMT1 | TGGCCCTGGGGCCGTTTCCCTCACTCCTGCTCGGTGAATTTGG CTCAGCAGGC ACCTGCCGAATTCTCAGCTGCTCACTTGAGCCTCTGGGTCTAG AACCCTCTGG (SEQ ID NO: 82) |

FIG. 70 illustrates in vitro cleavage assay of SpyCas9 and fusion proteins at C-terminus of SpyCas9 against human CCR5. The concentration of each RNP is 25 nM. 'Control A' means no treatment of both gRNA and protein. 'Control B' contains only sgRNA. 'Control C' is the mixture of sgRNA and protein. 'Control D' is the mixture of newly synthesized sgRNA and protein. Fusion proteins at C-terminus of Spy-Cas9 don't disturb SpyCas9 activity except for T5. Shown at the top is a gel and shown below is a bar graph showing percent cleavage efficiency for each group. FIG. 71 illustrates in vitro cleavage assay of SpyCas9 and fusion proteins at N- or N, C both termini of SpyCas9 against human CCR5. The concentration of each RNP is 25 nM. 'Control A' means no treatment of both gRNA and protein. 'Control B' contains only sgRNA. Fusion proteins at N- or both N, C termini of SpyCas9 don't disturb SpyCas9 activity except for SSB-SpyCas9. Shown at the top is a gel and shown below is a bar graph showing percent cleavage efficiency for each group. FIG. 72 illustrates in vitro cleavage assay of FnCpf1 and fusion proteins at C-terminus of FnCpf1 against human CCR5. The concentration of each RNP is 50 nM. 'Control A' contains only FnCpf1 protein. Fusion proteins at C-terminus of FnCpf1 don't disturb FnCpf1 activity except RecE, hTdT, RNP preparation and electroporation. Before transfection of CRISPR PLUS proteins to the cells, purified each SpyCas9 or FnCpf1 variant protein (33 pmol) and sgRNA or crRNA (66 pmol) were incubated at RT for 20 minutes for RNP complex. HDR template (20 pmol ssODN or 2 pmol dsDNA) was then added to RNP complex. Nucleofection of HEK293T cells was performed using Lonza. Each nucleofection reaction consisted of approximately $2 \times 10^5$ cells in 20 µl of nucleofection reagent and mixed with 10 µl of RNP: DNA.

Genomic DNA extraction. Genomic DNA extraction was performed using PureLink Genomic DNA kits following the manufacture's instruction.

Example 22: In Vivo Transfection and Deep Sequencing Analysis of On-Target Sites Deep sequencing analysis of on-target sites. The genomic region flanking the target site for each gene was amplified by two step PCR method. First, the genomic DNA from the edited and control samples was isolated and PCR amplified 35 cycles using Q5 High-fidelity DNA polymerase with adapter primers. The resulting amplicons were QIAquick PCR Purification kit. These samples were subjected to eight cycles of PCR using KAPA HotStart DNA Polymerase for indexing, followed by AMPure bead purification. Purified DNA samples were quantified by Qubit 2.0 Fluorometer, size analyzed by BioAnalyzer, and pooled in an equimolar ratio. Sequencing libraries were sequenced with the Illumina MiniSeq. Data was analyzed using Cas-Analyzer program.

TABLE 6

| Proteins | Genes | Adapter primer sequences (5'-3') |
|---|---|---|
| SpyCas9 | CCR5 | TCGTCGGCAGCGTCAGATGTGTATAAGAGACAGGGAGGGCAAC TAAATACATTCT (SEQ ID NO: 83) |
| | | GTCTCGTGGGCTCGGAGATGTGTATAAGAGACAGGAACACCAG TGAGTAGAGCGG (SEQ ID NO: 84) |
| | DHCR7 | TCGTCGGCAGCGTCAGATGTGTATAAGAGACAGGGTTTGAGCA ACAGTTCTCC (SEQ ID NO: 85) |
| | | GTCTCGTGGGCTCGGAGATGTGTATAAGAGACAGTGACGATGTC CACCACAG (SEQ ID NO: 86) |
| FnCpf1 | CCR5 | TCGTCGGCAGCGTCAGATGTGTATAAGAGACAGGGTATTTCTGT TCAGATCAC (SEQ ID NO: 87) |
| | | GTCTCGTGGGCTCGGAGATGTGTATAAGAGACAGGCCCATCAAT TATAGAAAGCC (SEQ ID NO: 88) |
| | DNMT1 | TCGTCGGCAGCGTCAGATGTGTATAAGAGACAGCTGCACACAG CAGGCCTTTG (SEQ ID NO: 89) |
| | | GTCTCGTGGGCTCGGAGATGTGTATAAGAGACAGCCCAATAAGT GGCAGAGTGC (SEQ ID NO: 90) |

Example 23: Editing Efficiency of Fusion SpyCas9 and FnCpf1 Constructs

This example shows editing efficiency of fusion SpyCas9 and FnCpf1 constructs of the present disclosure. The sequences of said constructs are shown in the table below.

The apparent rates of mutations after the action of CRISPR genome editing tools are relatively low in vivo due to outperformance of error-free repair mechanisms. To enhance both the rate of indel mutation and HR recombination, genome editing tools were constructed by translational fusion of DNA modifying enzymes (DME), DNA binding protein (DBP), or terminal deoxyribonucleotidyl transferase (TdT) at either upstream or downstream of CRISPR genome editing enzymes. In one embodiment, a variant irreversibly deleted the DNA at the CRISPR enzyme-dependent double strand break sites in 5'->3' direction, and the resulting modified ends with 3'-OH overhang can better serve HR repairs in presence of repair template. Disclosed herein are constructs that display functional enhancement of the CRISPR-Cas enzymes. Among Cas9-DME series, Cas9-RecJ showed the best performance in knock-out (KO) and knock-in (KI) performance efficiency in HEK293 cells and plant protoplasts. Second, Cas9-GFP exhibited high performance not only tracing the Cas9 protein due to GFP fluorescence but only genome editing for KO and KI. Third, unexpectedly, most exonuclease-fused Cas9 or Cpf1 did not show good performance in KO and KI as well as Cas9 or Cpf1. Fourth, off-target effects in Cas9-RecJ embodied the similar efficiency to Cas9 off-targeting in whole genome sequencing and targeted deep sequencing. Last, zinc sulfate effectively quenched Cas9 activity in vitro and in vivo HEK293 cells.

FIG. 74-FIG. 125 show said new genome editing fusion constructs, knock-out and knoc-in efficiency and percent change in efficiency over a control.

TABLE 7

| SEQ ID NO | Sequence | Description |
|---|---|---|
| 1 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGC**ATGGACAAGAAGTACAGCATCGGCC TGGACATCGGTACCAACAGCGTGGGCTGGGCCGTGATCACCGACGAGTAC AAGGTGCCCAGCAAGAAGTTCAAGGTGCTGGGCAACACCGACCGCCACAG CATCAAGAAGAACCTGATCGGCGCCCTGCTGTTCGACAGCGGCGAGACCG CCGAGGCCACCCGCCTGAAGCGCACCGCCCGCCGCCGCTACACCCGCCGC AAGAACCGCATCTGCTACCTGCAGGAGATCTTCAGCAACGAGATGGCCAAG GTGGACGACAGCTTCTTCCACCGCCTGGAGGAGAGCTTCCTGGTGGAGGA GGACAAGAAGCACGAGCGCCACCCCATCTTCGGCAACATCGTGGACGAGG TGGCCTACCACGAGAAGTACCCCACCATCTACCACCTGCGCAAGAAGCTGG TGGACAGCACCGACAAGGCCGACCTGCGCCTGATCTACCTGGCCCTGGCC CACATGATCAAGTTCCGCGGCCACTTCCTGATCGAGGGCGACCTGAACCCC GACAACAGCGACGTGGACAAGCTGTTCATCCAGCTGGTGCAGACCTACAAC CAGCTGTTCGAGGAGAACCCCATCAACGCCAGCGGCGTGGACGCCAAGGC CATCCTGAGCGCCCGCCTGAGCAAGAGCCGCCGCCTGGAGAACCTGATCG CCCAGCTGCCCGGCGAGAAGAAGAACGGCCTGTTCGGCAACCTGATCGCC CTGAGCCTGGGCCTGACCCCCAACTTCAAGAGCAACTTCGACCTGGCCGAG GACGCCAAGCTGCAGCTGAGCAAGGACACCTACGACGACGACCTGGACAA | Bold indicates SpyCas9 |

TABLE 7-continued

| SEQ ID NO | Sequence | Description |
|---|---|---|
| | CCTGCTGGCCCAGATCGGCGACCAGTACGCCGACCTGTTCCTGGCCGCCAA<br>GAACCTGAGCGACGCCATCCTGCTGAGCGACATCCTGCGCGTGAACACCG<br>AGATCACCAAGGCCCCCCTGAGCGCCAGCATGATCAAGCGCTACGACGAG<br>CACCACCAGGACCTGACCCTGCTGAAGGCCCTGGTGCGCCAGCAGCTGCC<br>CGAGAAGTACAAGGAGATCTTCTTCGACCAGAGCAAGAACGGCTACGCCG<br>GCTACATCGACGGCGGCGCCAGCCAGGAGGAGTTCTACAAGTTCATCAAG<br>CCCATCCTGGAGAAGATGGACGGCACCGAGGAGCTGCTGGTGAAGCTGAA<br>CCGCGAGGACCTGCTGCGCAAGCAGCGCACCTTCGACAACGGCAGCATCC<br>CCCACCAGATCCACCTGGGCGAGCTGCACGCCATCCTGCGCCGCCAGGAG<br>GACTTCTACCCCTTCCTGAAGGACAACCGCGAGAAGATCGAGAAGATCCTG<br>ACCTTCCGCATCCCCTACTACGTGGGCCCCCTGGCCCGCGGCAACAGCCGC<br>TTCGCCTGGATGACCCGCAAGAGCGAGGAGACCATCACCCCCTGGAACTTC<br>GAGGAGGTGGTGGACAAGGGCGCCAGCGCCCAGAGCTTCATCGAGCGCAT<br>GACCAACTTCGACAAGAACCTGCCCAACGAGAAGGTGCTGCCCAAGCACA<br>GCCTGCTGTACGAGTACTTCACCGTGTACAACGAGCTGACCAAGGTGAAGT<br>ACGTGACCGAGGGCATGCGCAAGCCCGCCTTCCTGAGCGGCGAGCAGAAG<br>AAGGCCATCGTGGACCTGCTGTTCAAGACCAACCGCAAGGTGACCGTGAA<br>GCAGCTGAAGGAGGACTACTTCAAGAAGATCGAGTGCTTCGACAGCGTGG<br>AGATCAGCGGCGTGGAGGACCGCTTCAACGCCAGCCTGGGCACCTACCAC<br>GACCTGCTGAAGATCATCAAGGACAAGGACTTCCTGGACAACGAGGAGAA<br>CGAGGACATCCTGGAGGACATCGTGCTGACCCTGACCCTGTTCGAGGACC<br>GCGAGATGATCGAGGAGCGCCTGAAGACCTACGCCCACCTGTTCGACGAC<br>AAGGTGATGAAGCAGCTGAAGCGCCGCCGCTACACCGGCTGGGGCCGCCT<br>GAGCCGCAAGCTTATCAACGGCATCCGCGACAAGCAGAGCGGCAAGACCA<br>TCCTGGACTTCCTGAAGAGCGACGGCTTCGCCAACCGCAACTTCATGCAGC<br>TGATCCACGACGACAGCCTGACCTTCAAGGAGGACATCCAGAAGGCCCAG<br>GTGAGCGGCCAGGGCGACAGCCTGCACGAGCACATCGCCAACCTGGCCGG<br>CAGCCCCGCCATCAAGAAGGGCATCCTGCAGACCGTGAAGGTGGTGGACG<br>AGCTGGTGAAGGTGATGGGCCGCCACAAGCCCGAGAACATCGTGATCGAG<br>ATGGCCCGCGAGAACCAGACCACCCAGAAGGGCCAGAAGAACAGCCGCGA<br>GCGCATGAAGCGCATCGAGGAGGGCATCAAGGAGCTGGGCAGCCAGATCC<br>TGAAGGAGCACCCCGTGGAGAACACCCAGCTGCAGAACGAGAAGCTGTAC<br>CTGTACTACCTGCAGAACGGCCGCGACATGTACGTGGACCAGGAGCTGGA<br>CATCAACCGCCTGAGCGACTACGACGTGGACCACATCGTGCCCCAGAGCTT<br>CCTGAAGGACGACAGCATCGACAACAAGGTGCTGACCCGCAGCGACAAGA<br>ACCGCGGCAAGAGCGACAACGTGCCCAGCGAGGAGGTGGTGAAGAAGATG<br>AAGAACTACTGGCGCCAGCTGCTGAACGCCAAGCTGATCACCCAGCGCAA<br>GTTCGACAACCTGACCAAGGCCGAGCGCGGCGGCCTGAGCGAGCTGGACA<br>AGGCCGGCTTCATCAAGCGCCAGCTGGTGGAGACCCGCCAGATCACCAAG<br>CACGTGGCCCAGATCCTGGACAGCCGCATGAACACCAAGTACGACGAGAA<br>CGACAAGCTGATCCGCGAGGTGAAGGTGATCACCCTGAAGAGCAAGCTGG<br>TGAGCGACTTCCGCAAGGACTTCCAGTTCTACAAGGTGCGCGAGATCAACA<br>ACTACCACCACGCCCACGACGCCTACCTGAACGCCGTGGTGGGCACCGCC<br>CTGATCAAGAAGTACCCCAAGCTGGAGAGCGAGTTCGTGTACGGCGACTAC<br>AAGGTGTACGACGTGCGCAAGATGATCGCCAAGAGCGAGCAGGAGATCGG<br>CAAGGCCACCGCCAAGTACTTCTTCTACAGCAACATCATGAACTTCTTCAA<br>GACCGAGATCACCCTGGCCAACGGCGAGATCCGCAAGCGCCCCCTGATCG<br>AGACCAACGGCGAGACCGGCGAGATCGTGTGGGACAAGGGCCGCGACTTC<br>GCCACCGTGCGCAAGGTGCTGAGCATGCCCCAGGTGAACATCGTGAAGAA<br>GACCGAGGTGCAGACCGGCGGCTTCAGCAAGGAGAGCATCCTGCCCAAGC<br>GCAACAGCGACAAGCTGATCGCCCGCAAGAAGGACTGGGACCCCAAGAAG<br>TACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGC<br>TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGACGCGCCGCACTCGACCTCGAGAAAGGCCGGCGGCCACGAAAA<br>AGGCCGGCCAGGCAAAAAGAAAGAGCACCACCACCACCACCACTGA | |
| 2 | MGSSHHHHHHSSGLVPRGSHMASMTGGQQMGRGSEFELRRQACGRMDKKYSIGL<br>DIGTNSVGWAVITDEYKVPSKKFKVLGNTDRHSIKKNLIGALLFDSGETAEATR<br>LKRTARRRYTRRKNRICYLQEIFSNEMAKVDDSFFIIRLEESFLVEEDKKHERH<br>PIFGNIVDEVAYHEKYPTIYHLRKKLVDSTDKADLRLIYLALAHMIKFRGHFLI<br>EGDLNPDNSDVDKLFIQLVQTYNQLFEENPINASGVDAKAILSARLSKSRRLEN<br>LIAQLPGEKKNGLFGNLIALSLGLTPNFKSNFDLAEDAKLQLSKDTYDDDLDNL<br>LAQIGDQYADLFLAAKNLSDAILLSDILRVNTEITKAPLSASMIKRYDEHHQDLT<br>LLKALVRQQLPEKYKEIFFDQSKNGYAGYIDGGASQEEFYKFIKPILEKMDGTE | Bold indicates SpyCas9 |

TABLE 7-continued

| SEQ ID NO | Sequence | Description |
|---|---|---|
| | ELLVKLNREDLLRKQRTFDNGSIPHQIHLGELHAILRRQEDFYPFLKDNREKIE KILTFRIPYYVGPLARGNSRFAWMTRKSEETITPWNFEEVVDKGASAQSFIERM TNFDKNLPNEKVLPKHSLLYEYFTVYNELTKVKYVTEGMRKPAFLSGEQKKAI VDLLFKTNRKVTVKQLKEDYFKKIECFDSVEISGVEDRFNASLGTYHDLLKIIK DKDFLDNEENEDILEDIVLTLTLFEDREMIEERLKTYAHLFDDKVMKQLKRRR YTGWGRLSRKLINGIRDKQSGKTILDFLKSDGFANRNFMQLIHDDSLTFKEDIQ KAQVSGQGDSLHEHIANLAGSPAIKKGILQTVKVVDELVKVMGRHKPENIVIE MARENQTTQKGQKNSRERMKRIEEGIKELGSQILKEHPVENTQLQNEKLYLY YLQNGRDMYVDQELDINRLSDYDVDHIVPQSFLKDDSIDNKVLTRSDKNRGKS DNVPSEEVVKKMKNYWRQLLNAKLITQRKFDNLTKAERGGLSELDKAGFIKR QLVETRQITKHVAQILDSRMNTKYDENDKLIREVKVITLKSKLVSDFRKDFQFY KVREINNYHHAHDAYLNAVVGTALIKKYPKLESEFVYGDYKVYDVRKMIAKSE QEIGKATAKYFFYSNIMNFFKTEITLANGEIRKRPLIETNGETGEIVWDKGRDF ATVRKVLSMPQVNIVKKTEVQTGGFSKESILPKRNSDKLIARKKDWDPKKYGG FDSPTVAYSVLVVAKVEKGKSKKLKSVKELLGITIMERSSFEKNPIDFLEAKGY KEVKKDLIIKLPKYSLFELENGRKRMLASAGELQKGNELALPSKYVNFLYLAS HYEKLKGSPEDNEQKQLFVEQHKHYLDEHEQISEFSKRVILADANLDKVLSAY NKHRDKPIREQAENIIHLFTLTNLGAPAAFKYFDTTIDRKRYTSTKEVLDATLIH QSITGLYETRIDLSQLGGDAAALDLEKRPAATKKAGQAKKKEHHHHHH | |
| 3 | ATGGGCAGCAGCCATCATCATCATCATCACAGCAGCGGCCTGGTGCCGCGCGG AGCCATATGGCTAGCATGACTGGTGGACAGCAAATGGGTCGCGGATCCGAATTC GAGCTCCGTCGACAAGCTTGCGGCCGCATGGACAAGAAGTACAGCATCGGCC TGGACATCGGTACCAACAGCGTGGGCTGGGCCGTGATCACCGACGAGTAC AAGGTGCCCAGCAAGAAGTTCAAGGTGCTGGGCAACACCGACCGCCACAG CATCAAGAAGAACCTGATCGGCGCCCTGCTGTTCGACAGCGGCGAGACCG CCGAGGCCACCCGCCTGAAGCGCACCGCCCGCCGCCGCTACACCCGCCGC AAGAACCGCATCTGCTACCTGCAGGAGATCTTCAGCAACGAGATGGCCAAG GTGGACGACAGCTTCTTCCACCGCCTGGAGGAGAGCTTCCTGGTGGAGGA GGACAAGAAGCACGAGCGCCACCCCATCTTCGGCAACATCGTGGACGAGG TGGCCTACCACGAGAAGTACCCCACCATCTACCACCTGCGCAAGAAGCTGG TGGACAGCACCGACAAGGCCGACCTGCGCCTGATCTACCTGGCCCTGGCC CACATGATCAAGTTCCGCGGCCACTTCCTGATCGAGGGCGACCTGAACCCC GACAACAGCGACGTGGACAAGCTGTTCATCCAGCTGGTGCAGACCTACAAC CAGCTGTTCGAGGAGAACCCCATCAACGCCAGCGGCGTGGACGCCAAGGC CATCCTGAGCGCCCGCCTGAGCAAGAGCCGCCGCCTGGAGAACCTGATCG CCCAGCTGCCCGGCGAGAAGAAGAACGGCCTGTTCGGCAACCTGATCGCC CTGAGCCTGGGCCTGACCCCCAACTTCAAGAGCAACTTCGACCTGGCCGAG GACGCCAAGCTGCAGCTGAGCAAGGACACCTACGACGACGACCTGGACAA CCTGCTGGCCCAGATCGGCGACCAGTACGCCGACCTGTTCCTGGCCGCCAA GAACCTGAGCGACGCCATCCTGCTGAGCGACATCCTGCGCGTGAACACCG AGATCACCAAGGCCCCCCTGAGCGCCAGCATGATCAAGCGCTACGACGAG CACCACCAGGACCTGACCCTGCTGAAGGCCCTGGTGCGCCAGCAGCTGCC CGAGAAGTACAAGGAGATCTTCTTCGACCAGAGCAAGAACGGCTACGCCG GCTACATCGACGGCGGCGCCAGCCAGGAGGAGTTCTACAAGTTCATCAAG CCCATCCTGGAGAAGATGGACGGCACCGAGGAGCTGCTGGTGAAGCTGAA CCGCGAGGACCTGCTGCGCAAGCAGCGCACCTTCGACAACGGCAGCATCC CCCACCAGATCCACCTGGGCGAGCTGCACGCCATCCTGCGCCGCCAGGAG GACTTCTACCCCTTCCTGAAGGACAACCGCGAGAAGATCGAGAAGATCCTG ACCTTCCGCATCCCCTACTACGTGGGCCCCCTGGCCCGCGGCAACAGCCGC TTCGCCTGGATGACCCGCAAGAGCGAGGAGACCATCACCCCCTGGAACTTC GAGGAGGTGGTGGACAAGGGCGCCAGCGCCCAGAGCTTCATCGAGCGCAT GACCAACTTCGACAAGAACCTGCCCAACGAGAAGGTGCTGCCCAAGCACA GCCTGCTGTACGAGTACTTCACCGTGTACAACGAGCTGACCAAGGTGAAGT ACGTGACCGAGGGCATGCGCAAGCCCGCCTTCCTGAGCGGCGAGCAGAAG AAGGCCATCGTGGACCTGCTGTTCAAGACCAACCGCAAGGTGACCGTGAA GCAGCTGAAGGAGGACTACTTCAAGAAGATCGAGTGCTTCGACAGCGTGG AGATCAGCGGCGTGGAGGACCGCTTCAACGCCAGCCTGGGCACCTACCAC GACCTGCTGAAGATCATCAAGGACAAGGACTTCCTGGACAACGAGGAGAA CGAGGACATCCTGGAGGACATCGTGCTGACCCTGACCCTGTTCGAGGACC GCGAGATGATCGAGGAGCGCCTGAAGACCTACGCCCACCTGTTCGACGAC AAGGTGATGAAGCAGCTGAAGCGCCGCCGCTACACCGGCTGGGGCCGCCT GAGCCGCAAGCTTATCAACGGCATCCGCGACAAGCAGAGCGGCAAGACCA TCCTGGACTTCCTGAAGAGCGACGGCTTCGCCAACCGCAACTTCATGCAGC TGATCCACGACGACAGCCTGACCTTCAAGGAGGACATCCAGAAGGCCCAG GTGAGCGGCCAGGGCGACAGCCTGCACGAGCACATCGCCAACCTGGCCGG CAGCCCCGCCATCAAGAAGGGCATCCTGCAGACCGTGAAGGTGGTGGACG AGCTGGTGAAGGTGATGGGCCGCCACAAGCCCGAGAACATCGTGATCGAG ATGGCCCGCGAGAACCAGACCACCCAGAAGGGCCAGAAGAACAGCCGCGA GCGCATGAAGCGCATCGAGGAGGGCATCAAGGAGCTGGGCAGCCAGATCC TGAAGGAGCACCCCGTGGAGAACACCCAGCTGCAGAACGAGAAGCTGTAC CTGTACTACCTGCAGAACGGCCGCGACATGTACGTGGACCAGGAGCTGGA CATCAACCGCCTGAGCGACTACGACGTGGACCACATCGTGCCCCAGAGCTT CCTGAAGGACGACAGCATCGACAACAAGGTGCTGACCCGCAGCGACAAGA ACCGCGGCAAGAGCGACAACGTGCCCAGCGAGGAGGTGGTGAAGAAGATG AAGAACTACTGGCGCCAGCTGCTGAACGCCAAGCTGATCACCCAGCGCAA | Bold indicates SpyCas9- Underlining indicates GFP |

TABLE 7-continued

| SEQ ID NO | Sequence | Description |
|---|---|---|
| | GTTCGACAACCTGACCAAGGCCGAGCGCGGCGGCCTGAGCGAGCTGGACA<br>AGGCCGGCTTCATCAAGCGCCAGCTGGTGGAGACCCGCCAGATCACCAAG<br>CACGTGGCCCAGATCCTGGACAGCCGCATGAACACCAAGTACGACGAGAA<br>CGACAAGCTGATCCGCGAGGTGAAGGTGATCACCCTGAAGAGCAAGCTGG<br>TGAGCGACTTCCGCAAGGACTTCCAGTTCTACAAGGTGCGCGAGATCAACA<br>ACTACCACCACGCCCACGACGCCTACCTGAACGCCGTGGTGGGCACCGCC<br>CTGATCAAGAAGTACCCCAAGCTGGAGAGCGAGTTCGTGTACGGCGACTAC<br>AAGGTGTACGACGTGCGCAAGATGATCGCCAAGAGCGAGCAGGAGATCGG<br>CAAGGCCACCGCCAAGTACTTCTTCTACAGCAACATCATGAACTTCTTCAA<br>GACCGAGATCACCCTGGCCAACGGCGAGATCCGCAAGCGCCCCCTGATCG<br>AGACCAACGGCGAGACCGGCGAGATCGTGTGGGACAAGGGCCGCGACTTC<br>GCCACCGTGCGCAAGGTGCTGAGCATGCCCCAGGTGAACATCGTGAAGAA<br>GACCGAGGTGCAGACCGGCGGCTTCAGCAAGGAGAGCATCCTGCCCAAGC<br>GCAACAGCGACAAGCTGATCGCCCGCAAGAAGGACTGGGACCCCAAGAAG<br>TACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGC<br>TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGACGCGGCCGCACTCGACCTCGAGATGAGTAAAGGAGAAGAACTTTT<br>CACTGGAGTTGTCCCAATTCTTGTTGAATTAGATGGTGATGTTAATGGGCACAA<br>ATTTTCTGTCAGTGGAGAGGGTGAAGGTGATGCAACATACGGAAAACTTACCCT<br>TAAATTTATTTGCACTACTGGAAAACTACCTGTTCCATGGCCAACACTTGTCACT<br>ACTTTCTCTTATGGTGTTCAATGCTTTTCAAGATACCCAGATCATATGAAGCGGC<br>ACGACTTCTTCAAGAGCGCCATGCCTGAGGGATACGTGCAGGAGAGGACCATCT<br>CTTTCAAGGACGACGGGAACTACAAGACACGTGCTGAAGTCAAGTTTGAGGGA<br>GACACCCTCGTCAACAGGATCGAGCTTAAGGGAATCGATTTCAAGGAGGACGG<br>AAACATCCTCGGCCACAAGTTGGAATACAACTACAACTCCCACAACGTATACAT<br>CACGGCAGACAAACAAAAGAATGGAATCAAAGCTAACTTCAAAATTAGACACA<br>ACATTGAAGATGGAAGCGTTCAACTAGCAGACCATTATCAACAAAATACTCCAA<br>TTGGCGATGGCCCTGTCCTTTTACCAGACAACCATTACCTGTCCACACAATCTGC<br>CCTTTCGAAAGATCCCAACGAAAAGAGAGACCACATGGTCCTTCTTGAGTTTGT<br>AACAGCTGCTGGGATTACACATGGCATGGATGAACTATACAAACTCGAGAAAA<br>GGCCGGCGGCCACGAAAAGGCCGGCCAGGCAAAAAGAAAAAGCACCACCA<br>CCACCACCACTGA | |
| 4 | MGSSHHHHHHSSGLVPRGSHMASMTGGQQMGRGSEFELRRQACGRMDKKYSIGL<br>DIGTNSVGWAVITDEYKVPSKKFKVLGNTDRHSIKKNLIGALLFDSGETAEATR<br>LKRTARRRYTRRKNRICYLQEIFSNEMAKVDDSFFHRLEESFLVEEDKKHERH<br>PIFGNIVDEVAYHEKYPTIYHLRKKLVDSTDKADLRLIYLALAHMIKFRGHFLI<br>EGDLNPDNSDVDKLFIQLVQTYNQLFEENPINASGVDAKAILSARLSKSRRLEN<br>LIAQLPGEKKNGLFGNLIALSLGLTPNFKSNFDLAEDAKLQLSKDTYDDDLDNL<br>LAQIGDQYADLFLAAKNLSDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQSFIERM<br>TNFDKNLPNEKVLPKHSLLYEYFTVYNELTKVKYVTEGMRKPAFLSGEQKKAI<br>VDLLFKTNRKVTVKQLKEDYFKKIECFDSVEISGVEDRFNASLGTYHDLLKIIK<br>DKDFLDNEENEDILEDIVLTLTLFEDREMIEERLKTYAHLFDDKVMKQLKRRR<br>YTGWGRLSRKLINGIRDKQSGKTILDFLKSDGFANRNFMQLIHDDSLTFKEDIQ<br>KAQVSGQGDSLHEHIANLAGSPAIKKGILQTVKVVDELVKVMGRHKPENIVIE<br>MARENQTTQKGQKNSRERMKRIEEGIKELGSQILKEHPVENTQLQNEKLYLY<br>YLQNGRDMYVDQELDINRLSDYDVDHIVPQSFLKDDSIDNKVLTRSDKNRGKS<br>DNVPSEEVVKKMKNYWRQLLNAKLITQRKFDNLTKAERGGLSELDKAGFIKR<br>QLVETRQITKHVAQILDSRMNTKYDENDKLIREVKVITLKSKINSDFRKDFQFY<br>KVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDF<br>ATVRKVLSMPQVNIVKKTEVQTGGFSKESILPKRNSDKLIARKKDWDPKKYGG<br>FDSPTVAYSVLVVAKVEKGKSKKLKSVKELLGITIMERSSFEKNPIDFLEAKGY<br>KEVKKDLIIKLPKYSLFELENGRKRMLASAGELQKGNELALPSKYVNFLYLAS<br>HYEKLKGSPEDNEQKQLFVEQHKHYLDEHEQISEFSKRVILADANLDKVLSAY<br>NKHRDKPIREQAENIIHLFTLTNLGAPAAFKYFDTTIDRKRYTSTKEVLDATLIH<br>QSITGLYETRIDLSQLGGDAAALDLEMSKGEELFTGVVPILVELDGDVNGHKFSVS<br>GEGEGDATYGKLTLKFICTTGKLPVPWPTLVTTFSYGVQCFSRYPDHMKRHDFFKS<br>AMPEGYVQERTISFKDDGNYKTRAEVKFEGDTLVNRIELKGIDFKEDGNILGHKLE | Bold indicates SpyCas9-Underlining indicates GFP |

TABLE 7-continued

| SEQ ID NO | Sequence | Description |
|---|---|---|
| | YNYNSHNVYITADKQKNGIKANFKIRHNIEDGSVQLADHYQQNTPIGDGPVLLPDN HYLSTQSALSKDPNEKRDHMVLLEFVTAAGITHGMDELYKLEKRPAATKKAGQAK KKKHHHHHH | |
| 5 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGCATGGACAAGAAGTACAGCATCGGCC TGGACATCGGTACCAACAGCGTGGGCTGGGCCGTGATCACCGACGAGTAC AAGGTGCCCAGCAAGAAGTTCAAGGTGCTGGGCAACACCGACCGCCACAG CATCAAGAAGAACCTGATCGGCGCCCTGCTGTTCGACAGCGGCGAGACCG CCGAGGCCACCCGCCTGAAGCGCACCGCCCGCCGCCGCTACACCCGCCGC AAGAACCGCATCTGCTACCTGCAGGAGATCTTCAGCAACGAGATGGCCAAG GTGGACGACAGCTTCTTCCACCGCCTGGAGGAGAGCTTCCTGGTGGAGGA GGACAAGAAGCACGAGCGCCACCCCATCTTCGGCAACATCGTGGACGAGG TGGCCTACCACGAGAAGTACCCCACCATCTACCACCTGCGCAAGAAGCTGG TGGACAGCACCGACAAGGCCGACCTGCGCCTGATCTACCTGGCCCTGGCC CACATGATCAAGTTCCGCGGCCACTTCCTGATCGAGGGCGACCTGAACCCC GACAACAGCGACGTGGACAAGCTGTTCATCCAGCTGGTGCAGACCTACAAC CAGCTGTTCGAGGAGAACCCCATCAACGCCAGCGGCGTGGACGCCAAGGC CATCCTGAGCGCCCGCCTGAGCAAGAGCCGCCGCCTGGAGAACCTGATCG CCCAGCTGCCCGGCGAGAAGAAGAACGGCCTGTTCGGCAACCTGATCGCC CTGAGCCTGGGCCTGACCCCAACTTCAAGAGCAACTTCGACCTGGCCGAG GACGCCAAGCTGCAGCTGAGCAAGGACACCTACGACGACGACCTGGACAA CCTGCTGGCCCAGATCGGCGACCAGTACGCCGACCTGTTCCTGGCCGCCAA GAACCTGAGCGACGCCATCCTGCTGAGCGACATCCTGCGCGTGAACACCG AGATCACCAAGGCCCCCCTGAGCGCCAGCATGATCAAGCGCTACGACGAG CACCACCAGGACCTGACCCTGCTGAAGGCCCTGGTGCGCCAGCAGCTGCC CGAGAAGTACAAGGAGATCTTCTTCGACCAGAGCAAGAACGGCTACGCCG GCTACATCGACGGCGGCGCCAGCCAGGAGGAGTTCTACAAGTTCATCAAG CCCATCCTGGAGAAGATGGACGGCACCGAGGAGCTGCTGGTGAAGCTGAA CCGCGAGGACCTGCTGCGCAAGCAGCGCACCTTCGACAACGGCAGCATCC CCCACCAGATCCACCTGGGCGAGCTGCACGCCATCCTGCGCCGCCAGGAG GACTTCTACCCCTTCCTGAAGGACAACCGCGAGAAGATCGAGAAGATCCTG ACCTTCCGCATCCCCTACTACGTGGGCCCCCTGGCCCGCGGCAACAGCCGC TTCGCCTGGATGACCCGCAAGAGCGAGGAGACCATCACCCCCTGGAACTTC GAGGAGGTGGTGGACAAGGGCGCCAGCGCCCAGAGCTTCATCGAGCGCAT GACCAACTTCGACAAGAACCTGCCCAACGAGAAGGTGCTGCCCAAGCACA GCCTGCTGTACGAGTACTTCACCGTGTACAACGAGCTGACCAAGGTGAAGT ACGTGACCGAGGGCATGCGCAAGCCCGCCTTCCTGAGCGGCGAGCAGAAG AAGGCCATCGTGGACCTGCTGTTCAAGACCAACCGCAAGGTGACCGTGAA GCAGCTGAAGGAGGACTACTTCAAGAAGATCGAGTGCTTCGACAGCGTGG AGATCAGCGGCGTGGAGGACCGCTTCAACGCCAGCCTGGGCACCTACCAC GACCTGCTGAAGATCATCAAGGACAAGGACTTCCTGGACAACGAGGAGAA CGAGGACATCCTGGAGGACATCGTGCTGACCCTGACCCTGTTCGAGGACC GCGAGATGATCGAGGAGCGCCTGAAGACCTACGCCCACCTGTTCGACGAC AAGGTGATGAAGCAGCTGAAGCGCCGCCGCTACACCGGCTGGGGCCGCCT GAGCCGCAAGCTTATCAACGGCATCCGCGACAAGCAGAGCGGCAAGACCA TCCTGGACTTCCTGAAGAGCGACGGCTTCGCCAACCGCAACTTCATGCAGC TGATCCACGACGACAGCCTGACCTTCAAGGAGGACATCCAGAAGGCCCAG GTGAGCGGCCAGGGCGACAGCCTGCACGAGCACATCGCCAACCTGGCCGG CAGCCCCGCCATCAAGAAGGGCATCCTGCAGACCGTGAAGGTGGTGGACG AGCTGGTGAAGGTGATGGGCCGCCACAAGCCCGAGAACATCGTGATCGAG ATGGCCCGCGAGAACCAGACCACCCAGAAGGGCCAGAAGAACAGCCGCGA GCGCATGAAGCGCATCGAGGAGGGCATCAAGGAGCTGGGCAGCCAGATCC TGAAGGAGCACCCCGTGGAGAACACCCAGCTGCAGAACGAGAAGCTGTAC CTGTACTACCTGCAGAACGGCCGCGACATGTACGTGGACCAGGAGCTGGA CATCAACCGCCTGAGCGACTACGACGTGGACCACATCGTGCCCCAGAGCTT CCTGAAGGACGACAGCATCGACAACAAGGTGCTGACCCGCAGCGACAAGA ACCGCGGCAAGAGCGACAACGTGCCCAGCGAGGAGGTGGTGAAGAAGATG AAGAACTACTGGCGCCAGCTGCTGAACGCCAAGCTGATCACCCAGCGCAA GTTCGACAACCTGACCAAGGCCGAGCGCGGCGGCCTGAGCGAGCTGGACA AGGCCGGCTTCATCAAGCGCCAGCTGGTGGAGACCCGCCAGATCACCAAG CACGTGGCCCAGATCCTGGACAGCCGCATGAACACCAAGTACGACGAGAA CGACAAGCTGATCCGCGAGGTGAAGGTGATCACCCTGAAGAGCAAGCTGG TGAGCGACTTCCGCAAGGACTTCCAGTTCTACAAGGTGCGCGAGATCAACA ACTACCACCACGCCCACGACGCCTACCTGAACGCCGTGGTGGGCACCGCC CTGATCAAGAAGTACCCCAAGCTGGAGAGCGAGTTCGTGTACGGCGACTAC AAGGTGTACGACGTGCGCAAGATGATCGCCAAGAGCGAGCAGGAGATCGG CAAGGCCACCGCCAAGTACTTCTTCTACAGCAACATCATGAACTTCTTCAA GACCGAGATCACCCTGGCCAACGGCGAGATCCGCAAGCGCCCCCTGATCG AGACCAACGGCGAGACCGGCGAGATCGTGTGGGACAAGGGCCGCGACTTC GCCACCGTGCGCAAGGTGCTGAGCATGCCCCAGGTGAACATCGTGAAGAA GACCGAGGTGCAGACCGGCGGCTTCAGCAAGGAGAGCATCCTGCCCAAGC GCAACAGCGACAAGCTGATCGCCCGCAAGAAGGACTGGGACCCCAAGAAG TACGGCGGCTTCGACAGCCCCACCGTGGCCTACAGCGTGCTGGTGGTGGC CAAGGTGGAGAAGGGCAAGAGCAAGAAGCTGAAGAGCGTGAAGGAGCTGC | Bold indicates SpyCas9- Underlining indicates hTdT |

TABLE 7-continued

| SEQ ID NO | Sequence | Description |
|---|---|---|
| | TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGAC<u>GCGGCCGCACTCGACCTGCAGATGGATCCACCGAGCGTCCCA<br>CTTGAGCCCTCGGAAGAAGAGACCCCGGCAGACGGGTGCCTTGATGGCCTCCTC<br>TCCTCAAGACATCAAATTTCAAGATTTGGTCGTCTTCATTTTGGAGAAGAAAAT<br>GGGAACCACCCGCAGAGCGTTCCTCATGGAGCTGGCCCGCAGGAAAGGGTTCA<br>GGGTTGAAAATGAGCTCAGTGATTCTGTCACCCACATTGTAGCAGAGAACAACT<br>CGGGTTCGGATGTTCTGGAGTGGCTTCAAGCACAGAAAGTACAAGTCAGCTCAC<br>AACCAGAGCTCCTCGATGTCTCCTGGCTGATCGAATGCATAGGAGCAGGGAAAC<br>CGGTGGAAATGACAGGAAAACACCAGCTTGTTGTGAGAAGAGACTATTCAGAT<br>AGCACCAACCCAGGCCCCCCGAAGACTCCACCAATTGCTGTACAAAAGATCTCC<br>CAGTATGCGTGTCAGAGAAGAACCACTTTAAACAACTGTAACCAGATATTCACG<br>GATGCCTTTGATATACTGGCTGAAAACTGTGAGTTTAGAGAAAATGAAGACTCC<br>TGTGTGACATTTATGAGAGCAGCTTCTGTATTGAAATCTCTGCCATTCACAATCA<br>TCAGTATGAAGGACACAGAAGGAATTCCCTGCCTGGGGTCCAAGGTGAAGGGT<br>ATCATAGAGGAGATTATTGAAGATGGAGAAAGTTCTGAAGTTAAAGCTGTGTTA<br>AATGATGAACGATATCAATCCTTCAAACTCTTTACTTCTGTATTTGGAGTGGGGC<br>TGAAGACTTCTGAGAAGTGGTTCAGGATGGGTTTCAGAACTCTGAGTAAAGTAA<br>GGTCGGACAAAAGCCTGAAATTTACACGAATGCAGAAAGCAGGATTTCTGTATT<br>ATGAAGACCTTGTCAGCTGTGTGACCAGGGCAGAAGCAGAGGCCGTCAGTGTG<br>CTGGTTAAAGAGGCTGTCTGGGCATTTCTTCCGGATGCTTTCGTCACCATGACAG<br>GAGGGTTCCGGAGGGGTAAGAAGATGGGGCATGATGTAGATTTTTTAATTACCA<br>GCCCAGGATCAACAGAGGATGAAGAGCAACTTTTACAGAAAGTGATGAACTTA<br>TGGGAAAAGAAGGGATTACTTTTATATTATGACCTTGTGGAGTCAACATTTGAA<br>AAGCTCAGGTTGCCTAGCAGGAAGGTTGATGCTTTGGATCATTTTCAAAAGTGC<br>TTTCTGATTTTCAAATTGCCTCGTCAAAGAGTGGACAGTGACCAGTCCAGCTGG<br>CAGGAAGGAAAGACCTGGAAGGCCATCCGTGTGGATTTAGTTCTGTGCCCCTAC<br>GAGCGTCGTGCCTTTGCCCTGTTGGGATGGACTGGCTCCCGGCAGTTTGAGAGA<br>GACCTCCGGCGCTATGCCACACATGAGCGGAAGATGATTCTGGATAACCATGCT<br>TTATATGACAAGACCAAGAGGATATTCCTCAAAGCAGAAAGTGAAGAAGAAT<br>TTTTGCGCATCTGGGATTGGATTATATTGAACCGTGGGAAAGAAATGCCCTGCA<br>GAAAAGGCCGGCGGCCACGAAAAAGGCCGGCCAGGCAAAAAAGAAAAGCAC<br>CACCACCACCACCACTGA</u> | |
| 6 | MGSSHHHHHHSSGLVPRGSHMASMTGGQQMGRGSEFELRRQACGRMDKKYSIGL<br>DIGTNSVGWAVITDEYKVPSKKFKVLGNTDRHSIKKNLIGALLFDSGETAEATR<br>LKRTARRRYTRRKNRICYLQEIFSNEMAKVDDSFFIIRLEESFLVEEDKKHERH<br>PIFGNIVDEVAYHEKYPTIYHIRKKLVDSTDKADLRLIYLALAHMIKFRGHFLI<br>EGDLNPDNSDVDKLFIQLVQTYNQLFEENPINASGVDAKAILSARLSKSRRLEN<br>LIAQLPGEKKNGLFGNLIALSLGLTPNFKSNFDLAEDAKLQLSKDTYDDDLDNL<br>LAQIGDQYADLFLAAKNISDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQSFIERM<br>TNFDKNITNEKVLPKHSLLYEYFTVYNELTKVKYVTEGMRKPAFLSGEQKKAI<br>VDLLFKTNRKVTVKQLKEDYFKKIECFDSVEISGVEDRFNASLGTYHDLLKIIK<br>DKDFLDNEENEDILEDIVLTLTLFEDREMIEERLKTYAHLFDDKVMKQLKRRR<br>YTGWGRLSRKLINGIRDKQSGKTILDFLKSDGFANRNFMQLIHDDSLTFKEDIQ<br>KAQVSGQGDSLHEHIANLAGSPAIKKGILQTVKVVDELVKVMGRHKPENIVIE<br>MARENQTTQKGQKNSRERMKRIEEGIKELGSQILKEHPVENTQLQNEKLYLY<br>YLQNGRDMYVDQELDINRLSDYDVDHIVPQSFLKDDSIDNKVLTRSDKNRGKS<br>DNVPSEEVVKKMKNYWRQLLNAKLITQRKFDNLTKAERGGLSELDKAGFIKR<br>QLVETRQITKIIVAQILDSRMNTKYDENDKLIREVKVITLKSKLVSDFRKDFQFY<br>KVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDF<br>ATVRKVLSMPQVNIVKKTEVQTGGFSKESILPKRNSDKLIARKKDWDPKKYGG<br>FDSPTVAYSVLVVAKVEKGKSKKLKSVKELLGITIMERSSFEKNPIDFLEAKGY<br>KEVKKDLIIKLPKYSLFELENGRKRMLASAGELQKGNELALPSKYVNFLYLAS<br>HYEKLKGSPEDNEQKQLFVEQHKHYLDEHEQISEFSKRVILADANLDKVLSAY<br>NKHRDKPIREQAENIIHLFTLTNLGAPAAFKYFDTTIDRKRYTSTKEVLDATLIH<br>QSITGLYETRIDLSQLGGDAAALDLQMDPPRASHLSPRKKRPRQTGALMASSPQDI<br><u>KFQDLVVFILEKKMGTTRRAFLMELARRKGFRVENELSDSVTHIVAENNSGSDVLE<br>WLQAQKVQVSSQPELLDVSWLIECIGAGKPVEMTGKHQLVRRDYSDSTNPGPPK<br>TPPIAVQKISQYACQRRTTLNNCNQIFTDAHNLAENCEFRENEDSCVTFMRAASVL<br>KSLPFTIISMKDTEGIPCLGSKVKGIIEEIIEDGESSEVKAVLNDERYQSFKLFTSVFGV<br>GLKTSEKWFRMGFRTLSKVRSDKSLKFTRMQKAGFLYYEDLVSCVTRAEAEAVSV</u> | Bold indicates SpyCas9-Underlining indicates hTdT |

TABLE 7-continued

| SEQ ID NO | Sequence | Description |
|---|---|---|
| | LVKEAVWAFLPDAFVTMTGGFRRGKKMGHDVDFLITSPGSTEDEEQLLQKVMNL<br>WEKKGLLLYYDLVESTFEKLRLPSRKVDALDHFQKCFLIFKLPRQRVDSDQSSWQE<br>GKTWKAIRVDLVLCPYERRAFALLGWTGSRQFERDLRRYATHERKMILDNHALYD<br>KTKRIFLKAESEEEIFAHLGLDYIEPWERNALQKRPAATKKAGQAKKKKHHHHHH | |
| 7 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCCGAATTC<br>GAGCTCCGTCGACAAGCTTGCGGCCGC**ATGGACAAGAAGTACAGCATCGGCC<br>TGGACATCGGTACCAACAGCGTGGGCTGGGCCGTGATCACCGACGAGTAC<br>AAGGTGCCCAGCAAGAAGTTCAAGGTGCTGGGCAACACCGACCGCCACAG<br>CATCAAGAAGAACCTGATCGGCGCCCTGCTGTTCGACAGCGGCGAGACCG<br>CCGAGGCCACCCGCCTGAAGCGCACCGCCCGCCGCCGCTACACCCGCCGC<br>AAGAACCGCATCTGCTACCTGCAGGAGATCTTCAGCAACGAGATGGCCAAG<br>GTGGACGACAGCTTCTTCCACCGCCTGGAGGAGAGCTTCCTGGTGGAGGA<br>GGACAAGAAGCACGAGCGCCACCCCATCTTCGGCAACATCGTGGACGAGG<br>TGGCCTACCACGAGAAGTACCCCACCATCTACCACCTGCGCAAGAAGCTGG<br>TGGACAGCACCGACAAGGCCGACCTGCGCCTGATCTACCTGGCCCTGGCC<br>CACATGATCAAGTTCCGCGGCCACTTCCTGATCGAGGGCGACCTGAACCCC<br>GACAACAGCGACGTGGACAAGCTGTTCATCCAGCTGGTGCAGACCTACAAC<br>CAGCTGTTCGAGGAGAACCCCATCAACGCCAGCGGCGTGGACGCCAAGGC<br>CATCCTGAGCGCCCGCCTGAGCAAGAGCCGCCGCCTGGAGAACCTGATCG<br>CCCAGCTGCCCGGCGAGAAGAAGAACGGCCTGTTCGGCAACCTGATCGCC<br>CTGAGCCTGGGCCTGACCCCCAACTTCAAGAGCAACTTCGACCTGGCCGAG<br>GACGCCAAGCTGCAGCTGAGCAAGGACACCTACGACGACGACCTGGACAA<br>CCTGCTGGCCCAGATCGGCGACCAGTACGCCGACCTGTTCCTGGCCGCCAA<br>GAACCTGAGCGACGCCATCCTGCTGAGCGACATCCTGCGCGTGAACACCG<br>AGATCACCAAGGCCCCCCTGAGCGCCAGCATGATCAAGCGCTACGACGAG<br>CACCACCAGGACCTGACCCTGCTGAAGGCCCTGGTGCGCCAGCAGCTGCC<br>CGAGAAGTACAAGGAGATCTTCTTCGACCAGAGCAAGAACGGCTACGCCG<br>GCTACATCGACGGCGGCGCCAGCCAGGAGGAGTTCTACAAGTTCATCAAG<br>CCCATCCTGGAGAAGATGGACGGCACCGAGGAGCTGCTGGTGAAGCTGAA<br>CCGCGAGGACCTGCTGCGCAAGCAGCGCACCTTCGACAACGGCAGCATCC<br>CCCACCAGATCCACCTGGGCGAGCTGCACGCCATCCTGCGCCGCCAGGAG<br>GACTTCTACCCCTTCCTGAAGGACAACCGCGAGAAGATCGAGAAGATCCTG<br>ACCTTCCGCATCCCCTACTACGTGGGCCCCCTGGCCCGCGGCAACAGCCGC<br>TTCGCCTGGATGACCCGCAAGAGCGAGGAGACCATCACCCCCTGGAACTTC<br>GAGGAGGTGGTGGACAAGGGCGCCAGCGCCCAGAGCTTCATCGAGCGCAT<br>GACCAACTTCGACAAGAACCTGCCCAACGAGAAGGTGCTGCCCAAGCACA<br>GCCTGCTGTACGAGTACTTCACCGTGTACAACGAGCTGACCAAGGTGAAGT<br>ACGTGACCGAGGGCATGCGCAAGCCCGCCTTCCTGAGCGGCGAGCAGAAG<br>AAGGCCATCGTGGACCTGCTGTTCAAGACCAACCGCAAGGTGACCGTGAA<br>GCAGCTGAAGGAGGACTACTTCAAGAAGATCGAGTGCTTCGACAGCGTGG<br>AGATCAGCGGCGTGGAGGACCGCTTCAACGCCAGCCTGGGCACCTACCAC<br>GACCTGCTGAAGATCATCAAGGACAAGGACTTCCTGGACAACGAGGAGAA<br>CGAGGACATCCTGGAGGACATCGTGCTGACCCTGACCCTGTTCGAGGACC<br>GCGAGATGATCGAGGAGCGCCTGAAGACCTACGCCCACCTGTTCGACGAC<br>AAGGTGATGAAGCAGCTGAAGCGCCGCCGCTACACCGGCTGGGGCCGCCT<br>GAGCCGCAAGCTTATCAACGGCATCCGCGACAAGCAGAGCGGCAAGACCA<br>TCCTGGACTTCCTGAAGAGCGACGGCTTCGCCAACCGCAACTTCATGCAGC<br>TGATCCACGACGACAGCCTGACCTTCAAGGAGGACATCCAGAAGGCCCAG<br>GTGAGCGGCCAGGGCGACAGCCTGCACGAGCACATCGCCAACCTGGCCGG<br>CAGCCCCGCCATCAAGAAGGGCATCCTGCAGACCGTGAAGGTGGTGGACG<br>AGCTGGTGAAGGTGATGGGCCGCCACAAGCCCGAGAACATCGTGATCGAG<br>ATGGCCCGCGAGAACCAGACCACCCAGAAGGGCCAGAAGAACAGCCGCGA<br>GCGCATGAAGCGCATCGAGGAGGGCATCAAGGAGCTGGGCAGCCAGATCC<br>TGAAGGAGCACCCCGTGGAGAACACCCAGCTGCAGAACGAGAAGCTGTAC<br>CTGTACTACCTGCAGAACGGCCGCGACATGTACGTGGACCAGGAGCTGGA<br>CATCAACCGCCTGAGCGACTACGACGTGGACCACATCGTGCCCCAGAGCTT<br>CCTGAAGGACGACAGCATCGACAACAAGGTGCTGACCCGCAGCGACAAGA<br>ACCGCGGCAAGAGCGACAACGTGCCCAGCGAGGAGGTGGTGAAGAAGATG<br>AAGAACTACTGGCGCCAGCTGCTGAACGCCAAGCTGATCACCCAGCGCAA<br>GTTCGACAACCTGACCAAGGCCGAGCGCGGCGGCCTGAGCGAGCTGGACA<br>AGGCCGGCTTCATCAAGCGCCAGCTGGTGGAGACCCGCCAGATCACCAAG<br>CACGTGGCCCAGATCCTGGACAGCCGCATGAACACCAAGTACGACGAGAA<br>CGACAAGCTGATCCGCGAGGTGAAGGTGATCACCCTGAAGAGCAAGCTGG<br>TGAGCGACTTCCGCAAGGACTTCCAGTTCTACAAGGTGCGCGAGATCAACA<br>ACTACCACCACGCCCACGACGCCTACCTGAACGCCGTGGTGGGCACCGCC<br>CTGATCAAGAAGTACCCCAAGCTGGAGAGCGAGTTCGTGTACGGCGACTAC<br>AAGGTGTACGACGTGCGCAAGATGATCGCCAAGAGCGAGCAGGAGATCGG<br>CAAGGCCACCGCCAAGTACTTCTTCTACAGCAACATCATGAACTTCTTCAA<br>GACCGAGATCACCCTGGCCAACGGCGAGATCCGCAAGCGCCCCCTGATCG<br>AGACCAACGGCGAGACCGGCGAGATCGTGTGGGACAAGGGCCGCGACTTC<br>GCCACCGTGCGCAAGGTGCTGAGCATGCCCCAGGTGAACATCGTGAAGAA<br>GACCGAGGTGCAGACCGGCGGCTTCAGCAAGGAGAGCATCCTGCCCAAGC<br>GCAACAGCGACAAGCTGATCGCCCGCAAGAAGGACTGGGACCCCAAGAAG<br>TACGGCGGCTTCGACAGCCCCACCGTGGCCTACAGCGTGCTGGTGGTGGC | Bold indicates SpyCas9-<br>Underlining indicates RecJ |

TABLE 7-continued

| SEQ ID NO | Sequence | Description |
|---|---|---|
| | CAAGGTGGAGAAGGGCAAGAGCAAGAAGCTGAAGAGCGTGAAGGAGCTGC<br>TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGAC<u>GCGGCCGCACTCGACCTGCAGGTGAAACAACAGATACAACTTCG<br>TCGCCGTGAAGTCGATGAAACGGCAGACTTGCCCGCTGAATTGCCTCCCTTGCT<br>GCGCCGTTTATACGCCAGCCGGGCGTGCGCAGTGCGCAAGAACTGGAACGCA<br>GTGTTAAAGGTATGTTGCCCTGGCAGCAACTGAGCGGCGTCGAAAAGGCCGTTG<br>AGATCCTTTACAACGCTTTTCGCGAAGGAACGCGGATTATTGTGGTCGGCGATT<br>TTGACGCCGACGGCGCGACCAGCACGGCTCTAAGCGTGCTGGCGATGCGCTCGC<br>TTGGTTGCAGCAATATCGACTATCTGGTACCAAACCGTTTCGAAGACGGTTACG<br>GCTTAAGCCCGGAAGTAGTCGATCAGGCCCATGCCCGTGGCGCGCAGTTAATTG<br>TCACGGTGGATAACGGTATTTCCTCCCATGCGGGCGTTGAACACGCTCGCTCGTT<br>GGGCATTCCGGTTATTGTTACCGATCACCATTTGCCGGGCGAAACATTACCCGC<br>AGCGGAAGCGATCATTAACCCTAACTTGCGCGACTGTAATTTCCCGTCGAAATC<br>ACTGGCAGGCGTGGGTGTGGCGTTTTATCTGATGCTGGCGCTGCGCACCTTTTTG<br>CGCGATCAGGGCTGGTTTGATGAGCGTGGCATCGCAATTCCTAACCTGGCAGAA<br>CTGCTGGATCTGGTCGCGCTGGGAACAGTGGCGGACGTCGTGCCGCTGGACGCT<br>AATAATCGCATTCTGACCTGGCAGGGGATGAGTCGCATCCGTGCCGGAAAGTGC<br>CGTCCAGGGATTAAAGCGCTGCTGGAAGTGGCAAACCGTGGCTGCACAAAAACT<br>CGCCGCCAGCGATTTAGGTTTTGCGCTGGGGCCACGTCTCAATGCTGCCGGACG<br>ACTGGACGATATGTCCGTCGGTGTGGCGCTCTTGCTGTGCGACAACATCGGCGA<br>AGCGCGCGTGCTGGCAAATGAACTCGATGCGCTAAACCAGACGCGAAAAGAGA<br>TCGAACAAGGAATGCAAGTTGAAGCCCTGACCCTGTGCGAGAAACTGGAGCGA<br>AGTGCGACACGCTACCCGGCGGGCTGGCAATGTATCACCCCGAATGGCATCAG<br>GGCGTTGTCGGTATTCTGGCTTCGCGCATCAAAGAGCGTTTTCACCGTCCGGTTA<br>TCGCCTTTGCGCCAGCAGGTGATGGTACGCTGAAAGGTTCAGGTCGCTCCATTC<br>AGGGGCTGCATATGCGTGATGCACTGGAGCGATTAGACACACTCTACCCTGGCA<br>TGATACTGAAGTTTGGCGGTCATGCGATGGCGGCGGGTTTGTCGCTGGAAGAGG<br>ATAAAATTCGAACTCTTTCAACAACGGTTTGGCGAGCTGGTTACCGAGTGGCTGG<br>ACCCTTCGCTATTGCAAGGCGAAGTGGTGTCAGACGGCCCGTTAAGCCCGGCCG<br>AAATGACCATGGAAGTGGCGCAGCTGCTGCGCGATGCTGGCCCGTGGGGCAG<br>ATGTTCCCGGAGCCGCTGTTTGATGGTCATTTCCGTCTGCTGCAACAGCGGCTGG<br>TGGGCGAACGTCATTTGAAAGTCATGGTCGAACCGGTCGGCGGCGGTCCGCTGC<br>TGGATGGTATTGCTTTTAATGTCGATACCGCCCTCTGGCCGGATAACGGCGTGC<br>GCGAAGTGCAACTGGCTTACAAGCTCGATATCAACGAGTTTCGCGGCAACCGCA<br>GCCTGCAAATTATCATCGACAATATCTGGCCAATTCTGCAGAAAAGGCCGGCGG<br>CCACGAAAAAGGCCGGCCAGGCAAAAAAGAAAAAGCACCACCACCACCACCA<br>CTGA</u> | |
| 8 | MGSSHHHHHHSSGLVPRGSHMASMTGGQQMGRGSEFELRRQACGRMDKKYSIGL<br>DIGTNSVGWAVITDEYKVPSKKFKVLGNTDRHSIKKNLIGALLFDSGETAEATR<br>LKRTARRRYTRRKNRICYLQEIFSNEMAKVDDSFFIIRLEESFLVEEDKKHERH<br>PIFGNIVDEVAYHEKYPTIYHIRKKLVDSTDKADLRLIYLALAHMIKFRGHFLI<br>EGDLNPDNSDVDKLFIQLVQTYNQLFEENPINASGVDAKAILSARLSKSRRLEN<br>LIAQLPGEKKNGLFGNLIALSLGLTPNFKSNFDLAEDAKLQLSKDTYDDDLDNL<br>LAQIGDQYADLFLAAKNISDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQSFIERM<br>TNFDKNITNEKVLPKHSLLYEYFTVYNELTKVKYVTEGMRKPAFLSGEQKKAI<br>VDLLFKTNRKVTVKQLKEDYFKKIECFDSVEISGVEDRFNASLGTYHDLLKIIK<br>DKDFLDNEENEDILEDIVLTLTLFEDREMIEERLKTYAHLFDDKVMKQLKRRR<br>YTGWGRLSRKLINGIRDKQSGKTILDFLKSDGFANRNFMQLIHDDSLTFKEDIQ<br>KAQVSGQGDSLHEHIANLAGSPAIKKGILQTVKVVDELVKVMGRHKPENIVIE<br>MARENQTTQKGQKNSRERMKRIEEGIKELGSQILKEHPVENTQLQNEKLYLY<br>YLQNGRDMYVDQELDINRLSDYDVDHIVPQSFLKDDSIDNKVLTRSDKNRGKS<br>DNVPSEEVVKKMKNYWRQLLNAKLITQRKFDNLTKAERGGLSELDKAGFIKR<br>QLVETRQITKHVAQILDSRMNTKYDENDKLIREVKVITLKSKLVSDFRKDFQFY<br>KVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDF<br>ATVRKVLSMPQVNIVKKTEVQTGGFSKESILPKRNSDKLIARKKDWDPKKYGG<br>FDSPTVAYSLVLVAKVEKGKSKKLSVKELLGITIMERSSFEKNPIDFLEAKGY<br>KEVKKDLIIKLPKYSLFELENGRKRMLASAGELQKGNELALPSKYVNFLYLAS<br>HYEKLKGSPEDNEQKQLFVEQHKHYLDEHEQISEFSKRVILADANLDKVLSAY<br>NKHRDKPIREQAENIIHLFTLTNLGAPAAFKYFDTTIDRKRYTSTKEVLDATLIH<br>QSITGLYETRIDLSQLGGDAAALDLQVKQQIQLRMIEVDETADLPAELPPLLRRLY | Bold indicates SpyCas9-<br>Underlining indicates RecJ |

TABLE 7-continued

| SEQ ID NO | Sequence | Description |
|---|---|---|
|  | ASRGVRSAQELERSVKGMLPWQQLSGVEKAVEILYNAFREGTRIIVVGDFDADGAT STALSVLAMRSLGCSNIDYLVPNRFEDGYGLSPEVVDQAHARGAQLIVTVDNGISSH AGVEHARSLGIPVIVTDHHLPGETLPAAEAIINPNLRDCNFPSKSLAGVGVAFYLML ALRTFLRDQGWFDERGIAIPNLAELLDLVALGTVADVVPLDANNRILTWQGMSRIR AGKCRPGIKALLEVANRDAQKLAASDLGFALGPRLNAAGRLDDMSVGVALLLCDN IGEARVLANELDALNQTRKEIEQGMQVEALTLCEKLERSRDTLPGGLAMYHPEWH QGVVGILASRIKERFHRPVIAFAPAGDGTLKGSGRSIQGLHMRDALERLDTLYPGMI LKFGGHAMAAGLSLEEDKFELFQQRFGELVIEWLDPSLLQGEVVSDGPLSPAEMT MEVAQLLRDAGPWGQMFPEPLFDGHFRLLQQRLVGERHLKVMVEPVGGGPLLDGI AFNVDTALWPDNGVREVQLAYKLDINEFRGNRSLQIIIDNIWPILQKRPAATKKAGQ AKKKKHHHHHH |  |
| 9 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGCATGGACAAGAAGTACAGCATCGGCC TGGACATCGGTACCAACAGCGTGGGCTGGGCCGTGATCACCGACGAGTAC AAGGTGCCCAGCAAGAAGTTCAAGGTGCTGGGCAACACCGACCGCCACAG CATCAAGAAGAACCTGATCGGCGCCCTGCTGTTCGACAGCGGCGAGACCG CCGAGGCCACCCGCCTGAAGCGCACCGCCCGCCGCCGCTACACCCGCCGC AAGAACCGCATCTGCTACCTGCAGGAGATCTTCAGCAACGAGATGGCCAAG GTGGACGACAGCTTCTTCCACCGCCTGGAGGAGAGCTTCCTGGTGGAGGA GGACAAGAAGCACGAGCGCCACCCCATCTTCGGCAACATCGTGGACGAGG TGGCCTACCACGAGAAGTACCCCACCATCTACCACCTGCGCAAGAAGCTGG TGGACAGCACCGACAAGGCCGACCTGCGCCTGATCTACCTGGCCCTGGCC CACATGATCAAGTTCCGCGGCCACTTCCTGATCGAGGGCGACCTGAACCCC GACAACAGCGACGTGGACAAGCTGTTCATCCAGCTGGTGCAGACCTACAAC CAGCTGTTCGAGGAGAACCCCATCAACGCCAGCGGCGTGGACGCCAAGGC CATCCTGAGCGCCCGCCTGAGCAAGAGCCGCCGCCTGGAGAACCTGATCG CCCAGCTGCCCGGCGAGAAGAAGAACGGCCTGTTCGGCAACCTGATCGCC CTGAGCCTGGGCCTGACCCCCAACTTCAAGAGCAACTTCGACCTGGCCGAG GACGCCAAGCTGCAGCTGAGCAAGGACACCTACGACGACGACCTGGACAA CCTGCTGGCCCAGATCGGCGACCAGTACGCCGACCTGTTCCTGGCCGCCAA GAACCTGAGCGACGCCATCCTGCTGAGCGACATCCTGCGCGTGAACACCG AGATCACCAAGGCCCCCCTGAGCGCCAGCATGATCAAGCGCTACGACGAG CACCACCAGGACCTGACCCTGCTGAAGGCCCTGGTGCGCCAGCAGCTGCC CGAGAAGTACAAGGAGATCTTCTTCGACCAGAGCAAGAACGGCTACGCCG GCTACATCGACGGCGGCGCCAGCCAGGAGGAGTTCTACAAGTTCATCAAG CCCATCCTGGAGAAGATGGACGGCACCGAGGAGCTGCTGGTGAAGCTGAA CCGCGAGGACCTGCTGCGCAAGCAGCGCACCTTCGACAACGGCAGCATCC CCCACCAGATCCACCTGGGCGAGCTGCACGCCATCCTGCGCCGCCAGGAG GACTTCTACCCCTTCCTGAAGGACAACCGCGAGAAGATCGAGAAGATCCTG ACCTTCCGCATCCCCTACTACGTGGGCCCCCTGGCCCGCGGCAACAGCCGC TTCGCCTGGATGACCCGCAAGAGCGAGGAGACCATCACCCCCTGGAACTTC GAGGAGGTGGTGGACAAGGGCGCCAGCGCCCAGAGCTTCATCGAGCGCAT GACCAACTTCGACAAGAACCTGCCCAACGAGAAGGTGCTGCCCAAGCACA GCCTGCTGTACGAGTACTTCACCGTGTACAACGAGCTGACCAAGGTGAAGT ACGTGACCGAGGGCATGCGCAAGCCCGCCTTCCTGAGCGGCGAGCAGAAG AAGGCCATCGTGGACCTGCTGTTCAAGACCAACCGCAAGGTGACCGTGAA GCAGCTGAAGGAGGACTACTTCAAGAAGATCGAGTGCTTCGACAGCGTGG AGATCAGCGGCGTGGAGGACCGCTTCAACGCCAGCCTGGGCACCTACCAC GACCTGCTGAAGATCATCAAGGACAAGGACTTCCTGGACAACGAGGAGAA CGAGGACATCCTGGAGGACATCGTGCTGACCCTGACCCTGTTCGAGGACC GCGAGATGATCGAGGAGCGCCTGAAGACCTACGCCCACCTGTTCGACGAC AAGGTGATGAAGCAGCTGAAGCGCCGCCGCTACACCGGCTGGGGCCGCCT GAGCCGCAAGCTTATCAACGGCATCCGCGACAAGCAGAGCGGCAAGACCA TCCTGGACTTCCTGAAGAGCGACGGCTTCGCCAACCGCAACTTCATGCAGC TGATCCACGACGACAGCCTGACCTTCAAGGAGGACATCCAGAAGGCCCAG GTGAGCGGCCAGGGCGACAGCCTGCACGAGCACATCGCCAACCTGGCCGG CAGCCCCGCCATCAAGAAGGGCATCCTGCAGACCGTGAAGGTGGTGGACG AGCTGGTGAAGGTGATGGGCCGCCACAAGCCCGAGAACATCGTGATCGAG ATGGCCCGCGAGAACCAGACCACCCAGAAGGGCCAGAAGAACAGCCGCGA GCGCATGAAGCGCATCGAGGAGGGCATCAAGGAGCTGGGCAGCCAGATCC TGAAGGAGCACCCCGTGGAGAACACCCAGCTGCAGAACGAGAAGCTGTAC CTGTACTACCTGCAGAACGGCCGCGACATGTACGTGGACCAGGAGCTGGA CATCAACCGCCTGAGCGACTACGACGTGGACCACATCGTGCCCCAGAGCTT CCTGAAGGACGACAGCATCGACAACAAGGTGCTGACCCGCAGCGACAAGA ACCGCGGCAAGAGCGACAACGTGCCCAGCGAGGAGGTGGTGAAGAAGATG AAGAACTACTGGCGCCAGCTGCTGAACGCCAAGCTGATCACCCAGCGCAA GTTCGACAACCTGACCAAGGCCGAGCGCGGCGGCCTGAGCGAGCTGGACA AGGCCGGCTTCATCAAGCGCCAGCTGGTGGAGACCCGCCAGATCACCAAG CACGTGGCCCAGATCCTGGACAGCCGCATGAACACCAAGTACGACGAGAA CGACAAGCTGATCCGCGAGGTGAAGGTGATCACCCTGAAGAGCAAGCTGG TGAGCGACTTCCGCAAGGACTTCCAGTTCTACAAGGTGCGCGAGATCAACA ACTACCACCACGCCCACGACGCCTACCTGAACGCCGTGGTGGGCACCGCC CTGATCAAGAAGTACCCCAAGCTGGAGAGCGAGTTCGTGTACGGCGACTAC AAGGTGTACGACGTGCGCAAGATGATCGCCAAGAGCGAGCAGGAGATCGG | Bold indicates SpyCas9- Underlining indicates RecE |

TABLE 7-continued

| SEQ ID NO | Sequence | Description |
|---|---|---|
| | CAAGGCCACCGCCAAGTACTTCTTCTACAGCAACATCATGAACTTCTTCAA<br>GACCGAGATCACCCTGGCCAACGGCGAGATCCGCAAGCGCCCCCTGATCG<br>AGACCAACGGCGAGACCGGCGAGATCGTGTGGGACAAGGGCCGCGACTTC<br>GCCACCGTGCGCAAGGTGCTGAGCATGCCCCAGGTGAACATCGTGAAGAA<br>GACCGAGGTGCAGACCGGCGGCTTCAGCAAGGAGAGCATCCTGCCCAAGC<br>GCAACAGCGACAAGCTGATCGCCCGCAAGAAGGACTGGGACCCCAAGAAG<br>TACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGC<br>TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGACGCGGCCGCACTCGACCTGCAGATGAGCACAAAACCACTCTTCCT<br><u>GTTACGGAAAGCGAAAAAATCATCCGGTGAACCTGACGTCGTCCTGTGGGCAA</u><br><u>GCAACGATTTTGAATCGACCTGTGCCACTCTGGACTACCTGATCGTTAAGTCAG</u><br><u>GTAAAAAACTGAGCAGCTATTTTAAAGCTGTTGCCACGAATTTTCCTGTCGTTAA</u><br><u>TGACCTGCCCGCTGAAGGTGAGATCGATTTTACCTGGAGTGAACGCTATCAACT</u><br><u>CAGCAAAGACTCCATGACATGGAACTAAAACCGGGAGCAGCACCAGACAACG</u><br><u>CTCACTATCAAGGCAATACCAACGTCAACGGCGAAGACATGACTGAGATTGAG</u><br><u>GAGAATATGCTACTCCCAATTTCTGGCCAGGAACTGCCCATTCGTTGGCTTGCTC</u><br><u>AACACGGCAGCGAAAAACCGGTAACGCACGTTTCACGCGACGGACTCCAGGCA</u><br><u>TTACACATTGCTCGGGCTGAAGAACTACCGGCTGTTACTGCCCTGGCTGTTTCCC</u><br><u>ACAAAACCAGCCTGCTCGACCCGCTGGAAATTCGCGAACTCCACAAACTGGTTC</u><br><u>GTGACACTGACAAAGTTTTCCCTAATCCTGGTAATTCAAACCTGGGACTGATAA</u><br><u>CTGCTTTTTTCGAAGCATACCTGAACGCTGACTACACCGATCGAGGACTGCTGA</u><br><u>CAAAAGAGTGGATGAAGGGTAATCGTGTTTCACACATCACTCGCACGGCTTCCG</u><br><u>GTGCTAATGCTGGCGGCGGAAACCTCACCGATCGCGGCGAAGGTTTCGTACACG</u><br><u>ATCTGACGTCACTGGCGCGCGACGTAGCCACTGGCGTACTGGCCCGTTCAATGG</u><br><u>ATCTGGACATCTATAACCTTCATCCGGCACACGCTAAACGCATTGAGGAAATTA</u><br><u>TCGCTGAAAATAAACCGCCCTTTTCTGTTTTCCGCACAAATTCATCACCATGCC</u><br><u>TGGCGGGCTGGATTATTCCCGCGCCATCGTGGTTGCGTCCGTAAAAGAAGCACC</u><br><u>AATTGGGATCGAGGTCATCCCCGCGCACGTCACTGAATATCTGAACAAAGTACT</u><br><u>GACTGAAACCGATCATGCCAACCCTGATCCGGAAATCGTGGATATTGCCTGCGG</u><br><u>TCGCTCCTCTGCCCCGATGCGCAGCGAGTAACAGAAGAAGGAAAACAGGATG</u><br><u>ATGAAGAAAACCGCAACCATCTGGAACAACGGCAGTTGAACAGGGAGAGGCT</u><br><u>GAAACAATGGAACCGGACGCAACTGAACATCATCAGGACACGCAGCCGCTGGA</u><br><u>TGCTCAGTCACAGGTAAATTCTGTTGATGCGAAATATCAGGAACTGCGGGCAGA</u><br><u>ACTCCATGAAGCCCGGAAAAACATTCCATCAAAAAATCCTGTCGATGACGATAA</u><br><u>ATTGCTTGCTGCATCACGTGGTGAATTTGTTGACGGAATTAGCGACCCGAACGA</u><br><u>TCCGAAATGGGTAAAGGGGATCCAGACTCGCGATTGTGTGTACCAGAACCAGCC</u><br><u>AGAAACGGAAAAAACCAGCCCAGATATGAATCAACCTGAGCCAGTAGTGCAAC</u><br><u>AGGAACCGGAAATAGCCTGCAATGCCTGCGGCCAGACTGGCGGGGATAACTGC</u><br><u>CCTGACTGTGGTGCGGTGATGGGCGACGCAACATACCAGGAAACATTCGATGA</u><br><u>AGAGAGTCAGGTTGAAGCTAAGGAAAATGATCCGGAGGAAATGGAAGGCGCTG</u><br><u>AACATCCGCACAATGAGAATGCTGGCAGCGATCCGCATCGCGATTGCAGTGATG</u><br><u>AAACTGGCGAAGTCGCAGATCCCGTAATCGTAGAAGACATAGAGCCAGGTATTT</u><br><u>ATTACGGAATTTCGAATGAGAATTACCACGCGGGTCCCGGTATCAGTAAGTCTC</u><br><u>AGCTCGATGACATTGCTGATACTCCGGCACTATATTTGTGGCGTAAAAATGCCC</u><br><u>CCGTGGACACCACAAAGACAAAAACGCTCGATTTAGGAACTGCTTTCCACTGCC</u><br><u>GGGTACTTGAACCGGAAGAATTCAGTAACCGCTTTATCGTAGCACCTGAATTTA</u><br><u>ACCGCCGTACAAACGCCGGAAAAGAAGAAGAGAAAGCGTTTCTGATGGAATGC</u><br><u>GCAAGCACAGGAAAAACGGTTATCACTGCGGAAGAAGGCCGGAAAATTGAACT</u><br><u>CATGTATCAAAGCGTTATGGCTTTGCCGCTGGGGCAATGGCTTGTTGAAAGCGC</u><br><u>CGGACACGCTGAATCATCAATTTACTGGGAAGATCCTGAAACAGGAATTTTGTG</u><br><u>TCGGTGCCGTCCGGACAAAATTATCCCTGAATTTCACTGGATCATGGACGTGAA</u><br><u>AACTACGGCGGATATTCAACGATTCAAAACCGCTTATTACGACTACCGCTATCA</u><br><u>CGTTCAGGATCATTCTACAGTGACGGTTATGAAGCACAGTTTGGAGTGCAGCC</u><br><u>AACTTTCGTTTTTCTGGTTGCCAGCACAACTATTGAATGCGGACGTTATCCGGTT</u><br><u>GAAATTTTCATGATGGGCGAAGAAGCAAAACTGGCAGGTCAACAGGAATATCA</u><br><u>CCGCAATCTGCGAACCCTGTCTGACTGCCTGAATACCGATGAATGGCCAGCTAT</u><br><u>TAAGACATTATCACTGCCCCGCTGGGCTAAGGAATATGCAAATGACCTGCAGAA</u><br><u>AAGGCCGGCGGCCACGAAAAAGGCCGGCCAGGCAAAAAAGAAAAAGCACCAC</u><br>CACCACCACCACTGA | |
| 10 | MGSSHHHHHHSSGLVPRGSHMASMTGGQQMGRGSEFELRRQACGRMDKKYSIGL<br>DIGTNSVGWAVITDEYKVPSKKFKVLGNTDRHSIKKNLIGALLFDSGETAEATR<br>LKRTARRRYTRRKNRICYLQEIFSNEMAKVDDSFFHRLEESFLVEEDKKHERH<br>PIFGNIVDEVAYHEKYPTIYHLRKKLVDSTDKADLRLIYLALAHMIKFRGHFLI | Bold indicates SpyCas9-<br>Underlining indicates RecE |

TABLE 7-continued

| SEQ ID NO | Sequence | Description |
|---|---|---|
| | EGDLNPDNSDVDKLFIQLVQTYNQLFEENPINASGVDAKAILSARLSKSRRLEN<br>LIAQLPGEKKNGLFGNLIALSLGLTPNFKSNFDLAEDAKLQLSKDTYDDDLDNL<br>LAQIGDQYADLFLAAKNLSDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQSFIERM<br>TNFDKNLPNEKVLPKHSLLYEYFTVYNELTKVKYVTEGMRKPAFLSGEQKKAI<br>VDLLFKTNRKVTVKQLKEDYFKKIECFDSVEISGVEDRFNASLGTYHDLLKIIK<br>DKDFLDNEENEDILEDIVLTLTLFEDREMIEERLKTYAHLFDDKVMKQLKRRR<br>YTGWGRLSRKLINGIRDKQSGKTILDFLKSDGFANRNFMQLIHDDSLTFKEDIQ<br>KAQVSGQGDSLHEHIANLAGSPAIKKGILQTVKVVDELVKVMGRHKPENIVIE<br>MARENQTTQKGQKNSRERMKRIEEGIKELGSQILKEHPVENTQLQNEKLYLY<br>YLQNGRDMYVDQELDINRLSDYDVDHIVPQSFLKDDSIDNKVLTRSDKNRGKS<br>DNVPSEEVVKKMKNYWRQLLNAKLITQRKFDNLTKAERGGLSELDKAGFIKR<br>QLVETRQITKIIVAQILDSRMNTKYDENDKLIREVKVITLKSKLVSDFRKDFQFY<br>KVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDF<br>ATVRKVLSMPQVNIVKKTEVQTGGFSKESILPKRNSDKLIARKKDWDPKKYGG<br>FDSPTVAYSVLVVAKVEKGKSKKLKSVKELLGITIMERSSFEKNPIDFLEAKGY<br>KEVKKDLIIKLPKYSLFELENGRKRMLASAGELQKGNELALPSKYVNFLYLAS<br>HYEKLKGSPEDNEQKQLFVEQHKHYLDEHEQISEFSKRVILADANLDKVLSAY<br>NKHRDKPIREQAENIIHLFTLTNLGAPAAFKYFDTTIDRKRYTSTKEVLDATLIH<br>QSITGLYETRIDLSQLGGD<u>AAALDLQMSTKPLFLLRKAKKSSGEPDVVLWASNDF<br>ESTCATLDYLIVKSGKKLSSYFKAVATNFPVVNDLPAEGEIDFTWSERYQLSKDSMT<br>WELKPGAAPDNAHYQGNTNVNGEDMTEIEENMLLPISGQELPIRWLAQHGSEKPVT<br>HVSRDGLQALHIARAEELPAVTALAVSHKTSLLDPLEIRELHKLVRDTDKVFPNPGN<br>SNLGLITAFFEAYLNADYTDRGLLTKEWMKGNRVSHITRTASGANAGGGNLTDRG<br>EGFVHDLTSLARDVATGVLARSMDLDIYNLHPAHAKRIEEIIAENKPPFSVFRDKFIT<br>MPGGLDYSRAIVVASVKEAPIGIEVIPAHVTEYLNKVLTETDHANPDTQPLDAQSQ<br>SAPMPQRVTEEGKQDDEEKPQPSGTTAVEQGEAETMEPDATEHHQDTQPLDAQSQ<br>VNSVDAKYQELRAELHEARKNIPSKNPVDDDKLLAASRGEFVDGISDPNDPKWVK<br>GIQTRDCVYQNQPEIEKTSPDMNQPEPVVQQEPEIACNACGQTGGDNCPDCGAVM<br>GDATYQETFDEESQVEAKENDPEEMEGAEHPHNENAGSDPHRDCSDETGEVADPVI<br>VEDIEPGIYYGISNENYHAGPGISKSQLDDIADTPALYLWRKNPVDTTKTKTLDLG<br>TAFHCRVLEPEEFSNRFIVAPEFNRRTNAGKEEEKAFLMECASTGKTVITAEEGRKIE<br>LMYQSVMALPLGQWLVESAGHAESSIYWEDPETGILCRCRPDKIIPEFHWIMDVKT<br>TADIQRFKTAYYDYRYHVQDAFYSDGYEAQFGVQPTFVFLVASTTIECGRYPVEIF<br>MMGEEAKLAGQQEYHRNLRTLSDCLNTDEWPAIKTLSLPRWAKEYANDLQKRPA<br>ATKKAGQAKKKKHHHHHH</u> | |
| 11 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCCGAATTC<br>GAGCTCCGTCGACAAGCTTGCGGCCGC**ATGGACAAGAAGTACAGCATCGGCC<br>TGGACATCGGTACCAACAGCGTGGGCTGGGCCGTGATCACCGACGAGTAC<br>AAGGTGCCCAGCAAGAAGTTCAAGGTGCTGGGCAACACCGACCGCCACAG<br>CATCAAGAAGAACCTGATCGGCGCCCTGCTGTTCGACAGCGGCGAGACCG<br>CCGAGGCCACCCGCCTGAAGCGCACCGCCCGCCGCCGCTACACCCGCCGC<br>AAGAACCGCATCTGCTACCTGCAGGAGATCTTCAGCAACGAGATGGCCAAG<br>GTGGACGACAGCTTCTTCCACCGCCTGGAGGAGAGCTTCCTGGTGGAGGA<br>GGACAAGAAGCACGAGCGCCACCCCATCTTCGGCAACATCGTGGACGAGG<br>TGGCCTACCACGAGAAGTACCCCACCATCTACCACCTGCGCAAGAAGCTGG<br>TGGACAGCACCGACAAGGCCGACCTGCGCCTGATCTACCTGGCCCTGGCC<br>CACATGATCAAGTTCCGCGGCCACTTCCTGATCGAGGGCGACCTGAACCCC<br>GACAACAGCGACGTGGACAAGCTGTTCATCCAGCTGGTGCAGACCTACAAC<br>CAGCTGTTCGAGGAGAACCCCATCAACGCCAGCGGCGTGGACGCCAAGGC<br>CATCCTGAGCGCCCGCCTGAGCAAGAGCCGCCGCCTGGAGAACCTGATCG<br>CCCAGCTGCCCGGCGAGAAGAAGAACGGCCTGTTCGGCAACCTGATCGCC<br>CTGAGCCTGGGCCTGACCCCCAACTTCAAGAGCAACTTCGACCTGGCCGAG<br>GACGCCAAGCTGCAGCTGAGCAAGGACACCTACGACGACGACCTGGACAA<br>CCTGCTGGCCCAGATCGGCGACCAGTACGCCGACCTGTTCCTGGCCGCCAA<br>GAACCTGAGCGACGCCATCCTGCTGAGCGACATCCTGCGCGTGAACACCG<br>AGATCACCAAGGCCCCCCTGAGCGCCAGCATGATCAAGCGCTACGACGAG<br>CACCACCAGGACCTGACCCTGCTGAAGGCCCTGGTGCGCCAGCAGCTGCC<br>CGAGAAGTACAAGGAGATCTTCTTCGACCAGAGCAAGAACGGCTACGCCG<br>GCTACATCGACGGCGGCGCCAGCCAGGAGGAGTTCTACAAGTTCATCAAG<br>CCCATCCTGGAGAAGATGGACGGCACCGAGGAGCTGCTGGTGAAGCTGAA<br>CCGCGAGGACCTGCTGCGCAAGCAGCGCACCTTCGACAACGGCAGCATCC<br>CCCACCAGATCCACCTGGGCGAGCTGCACGCCATCCTGCGCCGCCAGGAG<br>GACTTCTACCCCTTCCTGAAGGACAACCGCGAGAAGATCGAGAAGATCCTG<br>ACCTTCCGCATCCCCTACTACGTGGGCCCCTGGCCCGCGGCAACAGCCGC<br>TTCGCCTGGATGACCCGCAAGAGCGAGGAGACCATCACCCCCTGGAACTTC<br>GAGGAGGTGGTGGACAAGGGCGCCAGCGCCCAGAGCTTCATCGAGCGCAT<br>GACCAACTTCGACAAGAACCTGCCCAACGAGAAGGTGCTGCCCAAGCACA<br>GCCTGCTGTACGAGTACTTCACCGTGTACAACGAGCTGACCAAGGTGAAGT<br>ACGTGACCGAGGGCATGCGCAAGCCCGCCTTCCTGAGCGGCGAGCAGAAG<br>AAGGCCATCGTGGACCTGCTGTTCAAGACCAACCGCAAGGTGACCGTGAA | Bold indicates SpyCas9-<br>Underlining indicates lambda |

TABLE 7-continued

| SEQ ID NO | Sequence | Description |
|---|---|---|
| | GCAGCTGAAGGAGGACTACTTCAAGAAGATCGAGTGCTTCGACAGCGTGG<br>AGATCAGCGGCGTGGAGGACCGCTTCAACGCCAGCCTGGGCACCTACCAC<br>GACCTGCTGAAGATCATCAAGGACAAGGACTTCCTGGACAACGAGGAGAA<br>CGAGGACATCCTGGAGGACATCGTGCTGACCCTGACCCTGTTCGAGGACC<br>GCGAGATGATCGAGGAGCGCCTGAAGACCTACGCCCACCTGTTCGACGAC<br>AAGGTGATGAAGCAGCTGAAGCGCCGCCGCTACACCGGCTGGGGCCGCCT<br>GAGCCGCAAGCTTATCAACGGCATCCGCGACAAGCAGAGCGGCAAGACCA<br>TCCTGGACTTCCTGAAGAGCGACGGCTTCGCCAACCGCAACTTCATGCAGC<br>TGATCCACGACGACAGCCTGACCTTCAAGGAGGACATCCAGAAGGCCCAG<br>GTGAGCGGCCAGGGCGACAGCCTGCACGAGCACATCGCCAACCTGGCCGG<br>CAGCCCCGCCATCAAGAAGGGCATCCTGCAGACCGTGAAGGTGGTGGACG<br>AGCTGGTGAAGGTGATGGGCCGCCACAAGCCCGAGAACATCGTGATCGAG<br>ATGGCCCGCGAGAACCAGACCACCCAGAAGGGCCAGAAGAACAGCCGCGA<br>GCGCATGAAGCGCATCGAGGAGGGCATCAAGGAGCTGGGCAGCCAGATCC<br>TGAAGGAGCACCCCGTGGAGAACACCCAGCTGCAGAACGAGAAGCTGTAC<br>CTGTACTACCTGCAGAACGGCCGCGACATGTACGTGGACCAGGAGCTGGA<br>CATCAACCGCCTGAGCGACTACGACGTGGACCACATCGTGCCCCAGAGCTT<br>CCTGAAGGACGACAGCATCGACAACAAGGTGCTGACCCGCAGCGACAAGA<br>ACCGCGGCAAGAGCGACAACGTGCCCAGCGAGGAGGTGGTGAAGAAGATG<br>AAGAACTACTGGCGCCAGCTGCTGAACGCCAAGCTGATCACCCAGCGCAA<br>GTTCGACAACCTGACCAAGGCCGAGCGCGGCGGCCTGAGCGAGCTGGACA<br>AGGCCGGCTTCATCAAGCGCCAGCTGGTGGAGACCCGCCAGATCACCAAG<br>CACGTGGCCCAGATCCTGGACAGCCGCATGAACACCAAGTACGACGAGAA<br>CGACAAGCTGATCCGCGAGGTGAAGGTGATCACCCTGAAGAGCAAGCTGG<br>TGAGCGACTTCCGCAAGGACTTCCAGTTCTACAAGGTGCGCGAGATCAACA<br>ACTACCACCACGCCCACGACGCCTACCTGAACGCCGTGGTGGGCACCGCC<br>CTGATCAAGAAGTACCCCAAGCTGGAGAGCGAGTTCGTGTACGGCGACTAC<br>AAGGTGTACGACGTGCGCAAGATGATCGCCAAGAGCGAGCAGGAGATCGG<br>CAAGGCCACCGCCAAGTACTTCTTCTACAGCAACATCATGAACTTCTTCAA<br>GACCGAGATCACCCTGGCCAACGGCGAGATCCGCAAGCGCCCCCTGATCG<br>AGACCAACGGCGAGACCGGCGAGATCGTGTGGGACAAGGGCCGCGACTTC<br>GCCACCGTGCGCAAGGTGCTGAGCATGCCCCAGGTGAACATCGTGAAGAA<br>GACCGAGGTGCAGACCGGCGGCTTCAGCAAGGAGAGCATCCTGCCCAAGC<br>GCAACAGCGACAAGCTGATCGCCCGCAAGAAGGACTGGGACCCCAAGAAG<br>TACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGC<br>TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGAC<u>GCGGCCGCACTCGACCTCGAGATGACACCGGACATTATCCTGCA</u><br><u>GCGTACCGGGATCGATGTGAGAGCTGTCGAACAGGGGGATGATGCGTGGCACA</u><br><u>AATTACGGCTCGGCGTCATCACCGCTTCAGAAGTTCACAACGTGATAGCAAAAC</u><br><u>CCCGCTCCGGAAAGAAGTGGCCTGACATGAAAATGTCCTACTTCCACACCCTGC</u><br><u>TTGCTGAGGTTTGCACCGGTGTGGCTCCGGAAGTTAACGCTAAAGCACTGGCCT</u><br><u>GGGGAAAACAGTACGAGAACGACGCCAGAACCCTGTTTGAATTCACTTCCGGC</u><br><u>GTGAATGTTACTGAATCCCCGATCATCTATCGCGACGAAAGTATGCGTACCGCC</u><br><u>TGCTCTCCCGATGGTTTATGCAGTGACGGCAACGGCCTTGAACTGAAATGCCCG</u><br><u>TTTACCTCCCGGGATTTCATGAAGTTCCGGCTCGGTGGTTTCGAGGCCATAAAGT</u><br><u>CAGCTTACATGGCCCAGGTGCAGTACAGCATGTGGGTGACGCGAAAAAATGCCT</u><br><u>GGTACTTTGCCAACTATGACCCGCGTATGAAGCGTGAAGGCCTGCATTATGTCG</u><br><u>TGATTGAGCGGGATGAAAAGTACATGGCGAGTTTTGACGAGATCGTGCCGGAGT</u><br><u>TCATCGAAAAAATGGACGAGGCACTGGCTGAAATTGGTTTTGTATTTGGGAGC</u><br><u>AATGGCGA</u>CTCGAGAAAGGCCGGCGGCCACGAAAAGGCCGGCCAGGCAAA<br>AAAGAAAAAGCACCACCACCACCACCACTGA | |
| 12 | MGSSHHHHHHSSGLVPRGSHMASMTGGQQMGRGSEFELRRQACGRMDKKYSIGL<br>DIGTNSVGWAVITDEYKVPSKKFKVLGNTDRHSIKKNLIGALLFDSGETAEATR<br>LKRTARRRYTRRKNRICYLQEIFSNEMAKVDDSFFIIRLEESFLVEEDKKHERH<br>PIFGNIVDEVAYHEKYPTIYHIRKKLVDSTDKADLRLIYLALAHMIKFRGHFLI<br>EGDLNPDNSDVDKLFIQLVQTYNQLFEENPINASGVDAKAILSARLSKSRRLEN<br>LIAQLPGEKKNGLFGNLIALSLGLTPNFKSNFDLAEDAKLQLSKDTYDDDLDNL<br>LAQIGDQYADLFLAAKNISDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQSFIERM<br>TNFDKNITNEKVLPKHSLLYEYFTVYNELTKVKYVTEGMRKPAFLSGEQKKAI<br>VDLLFKTNRKVTVKQLKEDYFKKIECFDSVEISGVEDRFNASLGTYHDLLKIIK | Bold indicates SpyCas9-<br>Underlining indicates lambda |

TABLE 7-continued

| SEQ ID NO | Sequence | Description |
|---|---|---|
| | DKDFLDNEENEDILEDIVLTLTLFEDREMIEERLKTYAHLFDDKVMKQLKRRR YTGWGRLSRKLINGIRDKQSGKTILDFLKSDGFANRNFMQLIHDDSLTFKEDIQ KAQVSGQGDSLHEHIANLAGSPAIKKGILQTVKVVDELVKVMGRHKPENIVIE MARENQTTQKGQKNSRERMKRIEEGIKELGSQILKEHPVENTQLQNEKLYLY YLQNGRDMYVDQELDINRLSDYDVDHIVPQSFLKDDSIDNKVLTRSDKNRGKS DNVPSEEVVKKMKNYWRQLLNAKLITQRKFDNLTKAERGGLSELDKAGFIKR QLVETRQITKIIVAQILDSRMNTKYDENDKLIREVKVITLKSKLVSDFRKDFQFY KVREINNYHHAHDAYLNAVVGTALIKKYPKLESEFVYGDYKVYDVRKMIAKSE QEIGKATAKYFFYSNIMNFFKTEITLANGEIRKRPLIETNGETGEIVWDKGRDF ATVRKVLSMPQVNIVKKTEVQTGGFSKESILPKRNSDKLIARKKDWDPKKYGG FDSPTVAYSVLVVAKVEKGKSKKLKSVKELLGITIMERSSFEKNPIDFLEAKGY KEVKKDLIIKLPKYSLFELENGRKRMLASAGELQKGNELALPSKYVNFLYLAS HYEKLKGSPEDNEQKQLFVEQHKHYLDEHEQISEFSKRVILADANLDKVLSAY NKHRDKPIREQAENIIHLFTLTNLGAPAAFKYFDTTIDRKRYTSTKEVLDATLIH QSITGLYETRIDLSQLGGD<u>AAALDLEMTPDIILQRTGIDVRAVEQGDDAWHKLRL GVITASEVHNVIAKPRSGKKWPDMKMSYFHTLLAEVCTGVAPEVNAKALAWGKQ YENDARTLFEFTSGVNVTESPITYRDESMRTACSPDGLCSDGNGLELKCPFTSRDFM KFRLGGFEAIKSAYMAQVQYSMWVTRKNAWYFANYDPRMKREGLHYVVIERDEK YMASFDEIVPEFIEKMDEALAEIGFVFGEQWRL</u>EKRPAATKKAGQAKKKKHHHHH H | |
| 13 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGCAATGGACAAGAAGTACAGCATCGGCC TGGACATCGGTACCAACAGCGTGGGCTGGGCCGTGATCACCGACGAGTAC AAGGTGCCCAGCAAGAAGTTCAAGGTGCTGGGCAACACCGACCGCCACAG CATCAAGAAGAACCTGATCGGCGCCCTGCTGTTCGACAGCGGCGAGACCG CCGAGGCCACCCGCCTGAAGCGCACCGCCCGCCGCCGCTACACCCGCCGC AAGAACCGCATCTGCTACCTGCAGGAGATCTTCAGCAACGAGATGGCCAAG GTGGACGACAGCTTCTTCCACCGCCTGGAGGAGAGCTTCCTGGTGGAGGA GGACAAGAAGCACGAGCGCCACCCCATCTTCGGCAACATCGTGGACGAGG TGGCCTACCACGAGAAGTACCCCACCATCTACCACCTGCGCAAGAAGCTGG TGGACAGCACCGACAAGGCCGACCTGCGCCTGATCTACCTGGCCCTGGCC CACATGATCAAGTTCCGCGGCCACTTCCTGATCGAGGGCGACCTGAACCCC GACAACAGCGACGTGGACAAGCTGTTCATCCAGCTGGTGCAGACCTACAAC CAGCTGTTCGAGGAGAACCCCATCAACGCCAGCGGCGTGGACGCCAAGGC CATCCTGAGCGCCCGCCTGAGCAAGAGCCGCCGCCTGGAGAACCTGATCG CCCAGCTGCCCGGCGAGAAGAAGAACGGCCTGTTCGGCAACCTGATCGCC CTGAGCCTGGGCCTGACCCCCAACTTCAAGAGCAACTTCGACCTGGCCGAG GACGCCAAGCTGCAGCTGAGCAAGGACACCTACGACGACGACCTGGACAA CCTGCTGGCCCAGATCGGCGACCAGTACGCCGACCTGTTCCTGGCCGCCAA GAACCTGAGCGACGCCATCCTGCTGAGCGACATCCTGCGCGTGAACACCG AGATCACCAAGGCCCCCCTGAGCGCCAGCATGATCAAGCGCTACGACGAG CACCACCAGGACCTGACCCTGCTGAAGGCCCTGGTGCGCCAGCAGCTGCC CGAGAAGTACAAGGAGATCTTCTTCGACCAGAGCAAGAACGGCTACGCCG GCTACATCGACGGCGGCGCCAGCCAGGAGGAGTTCTACAAGTTCATCAAG CCCATCCTGGAGAAGATGGACGGCACCGAGGAGCTGCTGGTGAAGCTGAA CCGCGAGGACCTGCTGCGCAAGCAGCGCACCTTCGACAACGGCAGCATCC CCCACCAGATCCACCTGGGCGAGCTGCACGCCATCCTGCGCCGCCAGGAG GACTTCTACCCCTTCCTGAAGGACAACCGCGAGAAGATCGAGAAGATCCTG ACCTTCCGCATCCCCTACTACGTGGGCCCCCTGGCCCGCGGCAACAGCCGC TTCGCCTGGATGACCCGCAAGAGCGAGGAGACCATCACCCCCTGGAACTTC GAGGAGGTGGTGGACAAGGGCGCCAGCGCCCAGAGCTTCATCGAGCGCAT GACCAACTTCGACAAGAACCTGCCCAACGAGAAGGTGCTGCCCAAGCACA GCCTGCTGTACGAGTACTTCACCGTGTACAACGAGCTGACCAAGGTGAAGT ACGTGACCGAGGGCATGCGCAAGCCCGCCTTCCTGAGCGGCGAGCAGAAG AAGGCCATCGTGGACCTGCTGTTCAAGACCAACCGCAAGGTGACCGTGAA GCAGCTGAAGGAGGACTACTTCAAGAAGATCGAGTGCTTCGACAGCGTGG AGATCAGCGGCGTGGAGGACCGCTTCAACGCCAGCCTGGGCACCTACCAC GACCTGCTGAAGATCATCAAGGACAAGGACTTCCTGGACAACGAGGAGAA CGAGGACATCCTGGAGGACATCGTGCTGACCCTGACCCTGTTCGAGGACC GCGAGATGATCGAGGAGCGCCTGAAGACCTACGCCCACCTGTTCGACGAC AAGGTGATGAAGCAGCTGAAGCGCCGCCGCTACACCGGCTGGGGCCGCCT GAGCCGCAAGCTTATCAACGGCATCCGCGACAAGCAGAGCGGCAAGACCA TCCTGGACTTCCTGAAGAGCGACGGCTTCGCCAACCGCAACTTCATGCAGC TGATCCACGACGACAGCCTGACCTTCAAGGAGGACATCCAGAAGGCCCAG GTGAGCGGCCAGGGCGACAGCCTGCACGAGCACATCGCCAACCTGGCCGG CAGCCCCGCCATCAAGAAGGGCATCCTGCAGACCGTGAAGGTGGTGGACG AGCTGGTGAAGGTGATGGGCCGCCACAAGCCCGAGAACATCGTGATCGAG ATGGCCCGCGAGAACCAGACCACCCAGAAGGGCCAGAAGAACAGCCGCGA GCGCATGAAGCGCATCGAGGAGGGCATCAAGGAGCTGGGCAGCCAGATCC TGAAGGAGCACCCCGTGGAGAACACCCAGCTGCAGAACGAGAAGCTGTAC CTGTACTACCTGCAGAACGGCCGCGACATGTACGTGGACCAGGAGCTGGA CATCAACCGCCTGAGCGACTACGACGTGGACCACATCGTGCCCCAGAGCTT CCTGAAGGACGACAGCATCGACAACAAGGTGCTGACCCGCAGCGACAAGA ACCGCGGCAAGAGCGACAACGTGCCCAGCGAGGAGGTGGTGAAGAAGATG | Bold indicates SpyCas9- Underlining indicates mungbean |

| SEQ ID NO | Sequence | Description |
|---|---|---|
| | AAGAACTACTGGCGCCAGCTGCTGAACGCCAAGCTGATCACCCAGCGCAA GTTCGACAACCTGACCAAGGCCGAGCGCGGCGCCCTGAGCGAGCTGGACA AGGCCGGCTTCATCAAGCGCCAGCTGGTGGAGACCCGCCAGATCACCAAG CACGTGGCCCAGATCCTGGACAGCCGCATGAACACCAAGTACGACGAGAA CGACAAGCTGATCCGCGAGGTGAAGGTGATCACCCTGAAGAGCAAGCTGG TGAGCGACTTCCGCAAGGACTTCCAGTTCTACAAGGTGCGCGAGATCAACA ACTACCACCACGCCCACGACGCCTACCTGAACGCCGTGGTGGGCACCGCC CTGATCAAGAAGTACCCCAAGCTGGAGAGCGAGTTCGTGTACGGCGACTAC AAGGTGTACGACGTGCGCAAGATGATCGCCAAGAGCGAGCAGGAGATCGG CAAGGCCACCGCCAAGTACTTCTTCTACAGCAACATCATGAACTTCTTCAA GACCGAGATCACCCTGGCCAACGGCGAGATCCGCAAGCGCCCCCTGATCG AGACCAACGGCGAGACCGGCGAGATCGTGTGGGACAAGGGCCGCGACTTC GCCACCGTGCGCAAGGTGCTGAGCATGCCCCAGGTGAACATCGTGAAGAA GACCGAGGTGCAGACCGGCGGCTTCAGCAAGGAGAGCATCCTGCCCAAGC GCAACAGCGACAAGCTGATCGCCCGCAAGAAGGACTGGGACCCCAAGAAG TACGGCGGCTTCGACAGCCCCACCGTGGCCTACAGCGTGCTGGTGGTGGC CAAGGTGGAGAAGGGCAAGAGCAAGAAGCTGAAGAGCGTGAAGGAGCTGC TGGGCATCACCATCATGGAGCGCAGCAGCTTCGAGAAGAACCCCATCGACT TCCTGGAGGCCAAGGGCTACAAGGAGGTGAAGAAGGACCTGATCATCAAG CTGCCCAAGTACAGCCTGTTCGAGCTGGAGAACGGCCGCAAGCGCATGCT GGCCAGCGCCGGCGAGCTGCAGAAGGGCAACGAGCTGGCCCTGCCCAGCA AGTACGTGAACTTCCTGTACCTGGCCAGCCACTACGAGAAGCTGAAGGGCA GCCCCGAGGACAACGAGCAGAAGCAGCTGTTCGTGGAGCAGCACAAGCAC TACCTGGACGAGATCATCGAGCAGATCAGCGAGTTCAGCAAGCGCGTGATC CTGGCCGACGCCAACCTGGACAAGGTGCTGAGCGCCTACAACAAGCACCG CGACAAGCCCATCCGCGAGCAGGCCGAGAACATCATCCACCTGTTCACCCT GACCAACCTGGGCGCCCCCGCCGCCTTCAAGTACTTCGACACCACCATCGA CCGCAAGCGCTACACCAGCACCAAGGAGGTGCTGGACGCCACCCTGATCC ACCAGAGCATCACCGGTCTGTACGAGACCCGCATCGACCTGAGCCAGCTG GGCGGCGAC<u>GCGGCCGCACTCGACCTGCAGATGCAAACGTTACAGATGAGTCT GTTGACACAACCTTACGTTCAGCCTCGTTTCCCTTGCAAGCGTTACCCGACCTTC TCCGCATCCTGCAGAACTCAAAAGACAGCGATCACGAAACAGAGAAGGTGTT TTTCAGTGAGTCATTTGATCAAACACGTTGCACGCAGCCTCTCTCGGAAAAGAA GAAGAGGGTGTTCTTTTTGGACGTTAACCCGCTCTGTTTACGAAGGAAGCAAGCC CAGCTTGCGCTCCTTCGGGCGGTGGCTCTCTCTGTTTCTCCATCAAGTCAGCCTC ACTGACCCCGTCATTGCTGTTATTGATGGAGAAGGAGGCAGCGAGCATCGCAGA AAGTTGCTACCTTCATATAAAGCACATAGGAAAAGTTCATGAGACACATGTCA AGTGGCCATGTTGGGAGGTCTCATCAAGTTATAAATGATGTTCTTGGAAAATGC AACGTGCCAGTTATAAAGGTTGCTGGTCATGAAGCTGATGATGTTGTAGCTACT CTAGCTGGACAAGTTGTCAATAAAGGGTTTCGAGTGGTCATTGGCTCCCCTGAT AAGGATTTTAAGCAGCTTATATCTGAAGATGTGCAAATAGTTATGCCTTTGCCA GAGTTACAAAGGTGGTCCTTCTACACTCTGAGGCACTACAGGGATCAGTATAAT TGTGATCCAGAATCTGATCTGAGCTTTAGATGCATTGTAGGTGATGAAGTAGAC GGCGTTCCTGGTATCCAGCATTTGGTCCCTAGTTTTGGTCGGAAGACTGCTATGA AACTTATTAAAAAACATGGTTCCTTGGAAACTTTATTAAATGCGGCTGCAATAA GGACTGTAGGCAGACCATATGCACAGGATGCCCTCAAAAACCATGCTGATTACC TTCGGAGAAACTATGAAGTTCTTGCCTTGAAAAGGGATGTAAATATCCAACTTT ATGATGAGTGGTTGGTTAAGAGAGACAATCACAATGATAAAACTGCACTATCTT CCTTCTTCAAATATTTGGGAGAAAGTAAGGAGCTCAGTTACAATGGCAGACCTA TCTCTTACAATGGTCTGCAGAAAAGGCCGGCGGCCACGAAAAAGGCCGGCCAG GCAAAAAAGAAAAAGCACCACCACCACCACCACTGA</u> | |
| 14 | MGSSHHHHHHSSGLVPRGSHMASMTGGQQMGRGSEFELRRQACGRMDKKYSIGL DIGTNSVGWAVITDEYKVPSKKFKVLGNTDRHSIKKNLIGALLFDSGETAEATR LKRTARRRYTRRKNRICYLQEIFSNEMAKVDDSFFHRLEESFLVEEDKKHERH PIFGNIVDEVAYHEKYPTIYHLRKKLVDSTDKADLRLIYLALAHMIKFRGHFLI EGDLNPDNSDVDKLFIQLVQTYNQLFEENPINASGVDAKAILSARLSKSRRLEN LIAQLPGEKKNGLFGNLIALSLGLTPNFKSNFDLAEDAKLQLSKDTYDDDLDNL LAQIGDQYADLFLAAKNLSDAILLSDILRVNTEITKAPLSASMIKRYDEHHQDLT LLKKALVRQQLPEKYKEIFFDQSKNGYAGYIDGGASQEEFYKFIKPILEKMDGTE ELLVKLNREDLLRKQRTFDNGSIPHQIHLGELHAILRRQEDFYPFLKDNREKIE KILTFRIPYYVGPLARGNSRFAWMTRKSEETITPWNFEEVVDKGASAQSFIERM TNFDKNLPNEKVLPKHSLLYEYFTVYNELTKVKYVTEGMRKPAFLSGEQKKAI VDLLFKTNRKVTVKQLKEDYFKKIECFDSVEISGVEDRFNASLGTYHDLLKIIK DKDFLDNEENEDILEDIVLTLTLFEDREMIEERLKTYAHLFDDKVMKQLKRRR YTGWGRLSRKLINGIRDKQSGKTILDFLKSDGFANRNFMQLIHDDSLTFKEDIQ KAQVSGQGDSLHEHIANLAGSPAIKKGILQTVKVVDELVKVMGRHKPENIVIE MARENQTTQKGQKNSRERMKRIEEGIKELGSQILKEHPVENTQLQNEKLYLY YLQNGRDMYVDQELDINRLSDYDVDHIVPQSFLKDDSIDNKVLTRSDKNRGKS DNVPSEEVVKKMKNYWRQLLNAKLITQRKFDNLTKAERGGLSELDKAGFIKR QLVETRQITKHVAQILDSRMNTKYDENDKLIREVKVITLKSKLVSDFRKDFQFY KVREINNYHHAHDAYLNAVVGTALIKKYPKLESEFVYGDYKVYDVRKMIAKSE QEIGKATAKYFFYSNIMNFFKTEITLANGEIRKRPLIETNGETGEIVWDKGRDF ATVRKVLSMPQVNIVKKTEVQTGGFSKESILPKRNSDKLIARKKDWDPKKYGG FDSPTVAYSVLVVAKVEKGKSKKLKSVKELLGITIMERSSFEKNPIDFLEAKGY KEVKKDLIIKLPKYSLFELENGRKRMLASAGELQKGNELALPSKYVNFLYLAS | Bold indicates SpyCas9- Underlining indicates mungbean |

TABLE 7-continued

| SEQ ID NO | Sequence | Description |
|---|---|---|
| | HYEKLKGSPEDNEQKQLFVEQHKHYLDEHEQISEFSKRVILADANLDKVLSAY<br>NKHRDKPIREQAENIIHLFTLTNLGAPAAFKYFDTTIDRKRYTSTKEVLDATLIH<br>QSITGLYETRIDLSQLGGDAAALDLQMQTLQMSLLTQPVQPRFPCKRYPTFSASC<br>RTQKTAITKTEKVFFSESFDQTRCTQPLSEKKKRVFFLDVNPLCYEGSKPSLRSFGR<br>WLSLFLHQVSLTDPVIAVIDGEGGSEHRRKLLPSYKAHRKKFMRHMSSGHVGRSHQ<br>VINDVLGKCNVPVIKVAGHEADDVVATLAGQVVNKGFRVVIGSPDKDFKQLISEDV<br>QIVMPLPELQRWSFYTLRHYRDQYNCDPESDLSFRCIVGDEVDGVPGIQHLVPSFGR<br>KTAMKLIKKHGSLETLLNAAAIRTVGRPYAQDALKNHADYLRRNYEVLALKRDVN<br>IQLYDEWLVKRDNHNDKTALSSFFKYLGESKELSYNGRPISYNGLQKRPAATKKAG<br>QAKKKKHHHHHH | |
| 15 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCCGAATTC<br>GAGCTCCGTCGACAAGCTTGCGGCCGCATGGACAAGAAGTACAGCATCGGCC<br>TGGACATCGGTACCAACAGCGTGGGCTGGGCCGTGATCACCGACGAGTAC<br>AAGGTGCCCAGCAAGAAGTTCAAGGTGCTGGGCAACACCGACCGCCACAG<br>CATCAAGAAGAACCTGATCGGCGCCCTGCTGTTCGACAGCGGCGAGACCG<br>CCGAGGCCACCCGCCTGAAGCGCACCGCCCGCCGCCGCTACACCCGCCGC<br>AAGAACCGCATCTGCTACCTGCAGGAGATCTTCAGCAACGAGATGGCCAAG<br>GTGGACGACAGCTTCTTCCACCGCCTGGAGGAGAGCTTCCTGGTGGAGGA<br>GGACAAGAAGCACGAGCGCCACCCCATCTTCGGCAACATCGTGGACGAGG<br>TGGCCTACCACGAGAAGTACCCCACCATCTACCACCTGCGCAAGAAGCTGG<br>TGGACAGCACCGACAAGGCCGACCTGCGCCTGATCTACCTGGCCCTGGCC<br>CACATGATCAAGTTCCGCGGCCACTTCCTGATCGAGGGCGACCTGAACCCC<br>GACAACAGCGACGTGGACAAGCTGTTCATCCAGCTGGTGCAGACCTACAAC<br>CAGCTGTTCGAGGAGAACCCCATCAACGCCAGCGGCGTGGACGCCAAGGC<br>CATCCTGAGCGCCCGCCTGAGCAAGAGCCGCCGCCTGGAGAACCTGATCG<br>CCCAGCTGCCCGGCGAGAAGAAGAACGGCCTGTTCGGCAACCTGATCGCC<br>CTGAGCCTGGGCCTGACCCCCAACTTCAAGAGCAACTTCGACCTGGCCGAG<br>GACGCCAAGCTGCAGCTGAGCAAGGACACCTACGACGACGACCTGGACAA<br>CCTGCTGGCCCAGATCGGCGACCAGTACGCCGACCTGTTCCTGGCCGCCAA<br>GAACCTGAGCGACGCCATCCTGCTGAGCGACATCCTGCGCGTGAACACCG<br>AGATCACCAAGGCCCCCCTGAGCGCCAGCATGATCAAGCGCTACGACGAG<br>CACCACCAGGACCTGACCCTGCTGAAGGCCCTGGTGCGCCAGCAGCTGCC<br>CGAGAAGTACAAGGAGATCTTCTTCGACCAGAGCAAGAACGGCTACGCCG<br>GCTACATCGACGGCGGCGCCAGCCAGGAGGAGTTCTACAAGTTCATCAAG<br>CCCATCCTGGAGAAGATGGACGGCACCGAGGAGCTGCTGGTGAAGCTGAA<br>CCGCGAGGACCTGCTGCGCAAGCAGCGCACCTTCGACAACGGCAGCATCC<br>CCCACCAGATCCACCTGGGCGAGCTGCACGCCATCCTGCGCCGCCAGGAG<br>GACTTCTACCCCTTCCTGAAGGACAACCGCGAGAAGATCGAGAAGATCCTG<br>ACCTTCCGCATCCCCTACTACGTGGGCCCCCTGGCCCGCGGCAACAGCCGC<br>TTCGCCTGGATGACCCGCAAGAGCGAGGAGACCATCACCCCCTGGAACTTC<br>GAGGAGGTGGTGGACAAGGGCGCCAGCGCCCAGAGCTTCATCGAGCGCAT<br>GACCAACTTCGACAAGAACCTGCCCAACGAGAAGGTGCTGCCCAAGCACA<br>GCCTGCTGTACGAGTACTTCACCGTGTACAACGAGCTGACCAAGGTGAAGT<br>ACGTGACCGAGGGCATGCGCAAGCCCGCCTTCCTGAGCGGCGAGCAGAAG<br>AAGGCCATCGTGGACCTGCTGTTCAAGACCAACCGCAAGGTGACCGTGAA<br>GCAGCTGAAGGAGGACTACTTCAAGAAGATCGAGTGCTTCGACAGCGTGG<br>AGATCAGCGGCGTGGAGGACCGCTTCAACGCCAGCCTGGGCACCTACCAC<br>GACCTGCTGAAGATCATCAAGGACAAGGACTTCCTGGACAACGAGGAGAA<br>CGAGGACATCCTGGAGGACATCGTGCTGACCCTGACCCTGTTCGAGGACC<br>GCGAGATGATCGAGGAGCGCCTGAAGACCTACGCCCACCTGTTCGACGAC<br>AAGGTGATGAAGCAGCTGAAGCGCCGCCGCTACACCGGCTGGGGCCGCCT<br>GAGCCGCAAGCTTATCAACGGCATCCGCGACAAGCAGAGCGGCAAGACCA<br>TCCTGGACTTCCTGAAGAGCGACGGCTTCGCCAACCGCAACTTCATGCAGC<br>TGATCCACGACGACAGCCTGACCTTCAAGGAGGACATCCAGAAGGCCCAG<br>GTGAGCGGCCAGGGCGACAGCCTGCACGAGCACATCGCCAACCTGGCCGG<br>CAGCCCCGCCATCAAGAAGGGCATCCTGCAGACCGTGAAGGTGGTGGACG<br>AGCTGGTGAAGGTGATGGGCCGCCACAAGCCCGAGAACATCGTGATCGAA<br>ATGGCCCGCGAGAACCAGACCACCCAGAAGGGCCAGAAGAACAGCCGCGA<br>GCGCATGAAGCGCATCGAGGAGGGCATCAAGGAGCTGGGCAGCCAGATCC<br>TGAAGGAGCACCCCGTGGAGAACACCCAGCTGCAGAACGAGAAGCTGTAC<br>CTGTACTACCTGCAGAACGGCCGCGACATGTACGTGGACCAGGAGCTGGA<br>CATCAACCGCCTGAGCGACTACGACGTGGACCACATCGTGCCCCAGAGCTT<br>CCTGAAGGACGACAGCATCGACAACAAGGTGCTGACCCGCAGCGACAAGA<br>ACCGCGGCAAGAGCGACAACGTGCCCAGCGAGGAGGTGGTGAAGAAGATG<br>AAGAACTACTGGCGCCAGCTGCTGAACGCCAAGCTGATCACCCAGCGCAA<br>GTTCGACAACCTGACCAAGGCCGAGCGCGGCGGCCTGAGCGAGCTGGACA<br>AGGCCGGCTTCATCAAGCGCCAGCTGGTGGAGACCCGCCAGATCACCAAG<br>CACGTGGCCCAGATCCTGGACAGCCGCATGAACACCAAGTACGACGAGAA<br>CGACAAGCTGATCCGCGAGGTGAAGGTGATCACCCTGAAGAGCAAGCTGG<br>TGAGCGACTTCCGCAAGGACTTCCAGTTCTACAAGGTGCGCGAGATCAACA<br>ACTACCACCACGCCCACGACGCCTACCTGAACGCCGTGGTGGGCACCGCC<br>CTGATCAAGAAGTACCCCAAGCTGGAGAGCGAGTTCGTGTACGGCGACTAC<br>AAGGTGTACGACGTGCGCAAGATGATCGCCAAGAGCGAGCAGGAGATCGG<br>CAAGGCCACCGCCAAGTACTTCTTCTACAGCAACATCATGAACTTCTTCAA | Bold indicates SpyCas9- Underlining indicates T5 |

TABLE 7-continued

| SEQ ID NO | Sequence | Description |
|---|---|---|
| | GACCGAGATCACCCTGGCCAACGGCGAGATCCGCAAGCGCCCCCTGATCG<br>AGACCAACGGCGAGACCGGCGAGATCGTGTGGGACAAGGGCCGCGACTTC<br>GCCACCGTGCGCAAGGTGCTGAGCATGCCCCAGGTGAACATCGTGAAGAA<br>GACCGAGGTGCAGACCGGCGGCTTCAGCAAGGAGAGCATCCTGCCCAAGC<br>GCAACAGCGACAAGCTGATCGCCCGCAAGAAGGACTGGGACCCCAAGAAG<br>TACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGC<br>TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGACGCGGCCGCACTCGACCTGCAGATGGCTTCCCGTCGTAATCTAAT<br>GATTGTCGATGGAACTAACTTAGGCTTTCGCTTCAAACATAACAATAGTAAAAA<br>ACCATTTGCCTCAAGTTATGTTTCAACTATTCAATCTCTGGCAAAATCCTACTCT<br>GCCAGAACTACGATTGTTCTAGGTGATAAGGGAAAATCTGTATTTCGTCTAGAA<br>CATCTACCAGAGTATAAAGGTAATCGTGATGAAAAGTACGCACAACGTACGGA<br>AGAGGAGAAAGCGCTAGATGAGCAGTTCTTTGAGTATTTGAAGGATGCTTTCGA<br>GTTGTGTAAAACTACATTCCCAACTTTTACCATTCGTGGTGTAGAAGCAGACGA<br>TATGGCAGCTTATATTGTTAAGCTCATCGGCATCTTTATGATCACGTTTGGCTA<br>ATATCTACAGATGGTGACTGGGATACTTTATTAACGGATAAAGTTTCTCGTTTTT<br>CTTTCACAACACGTCGTGAGTATCATCTTCGTGATATGTATGAACATCATAATGT<br>TGATGATGTTGAGCAGTTTATCTCCCTGAAAGCAATTATGGGAGATCTAGGAGA<br>TAATATTCGTGGTGTTGAAGGAATAGGAGCAAAACGCGGATAATATTATTCG<br>TGAGTTTGGTAACGTACTGGATATTATTGATCAGCTTCCACTGCCTGGAAAGCA<br>GAAATATATACAGAACCTGAATGCATCGGAAGAACTGCTTTTCCGAAACTTGAT<br>TCTGGTTGATTTACCTACCTACTGTGTGGATGCTATTGCTGCTGTAGGTCAAGAT<br>GTGTTAGATAAGTTTACAAAAGATATTTTGGAGATTGCAGAACAACTGCAGAAA<br>AGGCCGGCGGCCACGAAAAAGGCCGGCCAGGCAAAAAAGAAAAAGCACCACC<br>ACCACCACCACTGA | |
| 16 | MGSSHHHHHSSGLVPRGSHMASMTGGQQMGRGSEFELRRQACGRMDKKYSIGL<br>DIGTNSVGWAVITDEYKVPSKKFKVIGNTDRHSIKKNLIGALLFDSGETAEATR<br>LKRTARRRYTRRKNRICYLQEIFSNEMAKVDDSFFIIRLEESFLVEEDKKHERH<br>PIFGNIVDEVAYHEKYPTIYHIRKKLVDSTDKADLRLIYLALAHMIKFRGHFLI<br>EGDLNPDNSDVDKLFIQLVQTYNQLFEENPINASGVDAKAILSARLSKSRRLEN<br>LIAQLPGEKKNGLFGNLIALSLGLTPNFKSNFDLAEDAKLQLSKDTYDDDLDNL<br>LAQIGDQYADLFLAAKNISDAILLSDILRVNTEITKAPLSASMIKRYDEHHQDLT<br>LLKALVRQQLPEKYKEIFFDQSKNGYAGYIDGGASQEEFYKFIKPILEKMDGTE<br>ELLVKLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQSFIERM<br>TNFDKNITNEKVLPKHSLLYEYFTVYNELTKVKYVTEGMRKPAFLSGEQKKAI<br>VDLLFKTNRKVTVKQLKEDYFKKIECFDSVEISGVEDRFNASLGTYHDLLKIIK<br>DKDFLDNEENEDILEDIVLTLTLFEDREMIEERLKTYAHLFDDKVMKQLKRRR<br>YTGWGRLSRKLINGIRDKQSGKTILDFLKSDGFANRNFMQLIHDDSLTFKEDIQ<br>KAQVSGQGDSLHEHIANLAGSPAIKKGILQTVKVVDELVKVMGRHKPENIVIE<br>MARENQTTQKGQKNSRERMKRIEEGIKELGSQILKEHPVENTQLQNEKLYLY<br>YLQNGRDMYVDQELDINRLSDYDVDHIVPQSFLKDDSIDNKVLTRSDKNRGKS<br>DNVPSEEVVKKMKNYWRQLLNAKLITQRKFDNLTKAERGGLSELDKAGFIKR<br>QLVETRQITKIIVAQILDSRMNTKYDENDKLIREVKVITLKSKLVSDFRKDFQFY<br>KVREINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGRDF<br>ATVRKVLSMPQVNIVKKTEVQTGGFSKESILPKRNSDKLIARKKDWDPKKYGG<br>FDSPTVAYSVLVVAKVEKGKSKKLKSVKELLGITIMERSSFEKNPIDFLEAKGY<br>KEVKKDLIIKLPKYSLFELENGRKRMLASAGELQKGNELALPSKYVNFLYLAS<br>HYEKLKGSPEDNEQKQLFVEQHKHYLDEHEQISEFSKRVILADANLDKVLSAY<br>NKHRDKPIREQAENIIHLFTLTNLGAPAAFKYFDTTIDRKRYTSTKEVLDATLIH<br>QSITGLYETRIDLSQLGGDAAALDLQMASRRNLMIVDGTNLGFRFKHNNSKKPFA<br>SSYVSTIQSLAKSYSARTTIVLGDKGKSVFRLEHLPEYKGNRDEKYAQRTEEEKALD<br>EQFFEYLKDAFELCKTTPFPTFTIRGVEADDMAAYIVKLGHLYDHVWLISTDGDWD<br>TLLTDKVSRFSFTTRREYHLRDMYEHHNVDDVEQFISLKAIMGDLGDNIRGVEGIG<br>AKRGYNIIREFGNVLDIIDQLPLPGKQKYIQNLNASEELLFRNLILVDLPTYCVDAIA<br>AVGQDVLDKFTKDILEIAEQLQKRPAATKKAGQAKKKKHHHHHH | Bold indicates SpyCas9-<br>Underlining indicates T5 |
| 17 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCCGTGAA<br>ACAACAGATACAACTTCGTCGCCGTGAAGTCGATGAAACGGCAGACTTGCCCGC<br>TGAATTGCCTCCCTTGCTGCGCCGTTTATACGCCAGCCGGGGCGTGCGCAGTGC<br>GCAAGAACTGGAACGCAGTGTTAAAGGTATGTTGCCCTGGCAGCAACTGAGCG | Underlining indicates Rec J-Bold indicates SpyCas9 |

TABLE 7-continued

| SEQ ID NO | Sequence | Description |
|---|---|---|
| | GCGTCGAAAAGGCCGTTGAGATCCTTTACAACGCTTTTCGCGAAGGAACGCGGA<br>TTATTGTGGTCGGCGATTTTGACGCCGACGGCGCGACCAGCACGGCTCTAAGCG<br>TGCTGGCGATGCGCTCGCTTGGTTGCAGCAATATCGACTATCTGGTACCAAACC<br>GTTTCGAAGACGGTTACGGCTTAAGCCCGGAAGTAGTCGATCAGGCCCATGCCC<br>GTGGCGCGCAGTTAATTGTCACGGTGGATAACGGTATTTCCTCCCATGCGGGCG<br>TTGAACACGCTCGCTCGTTGGGCATTCCGGTTATTGTTACCGATCACCATTTGCC<br>GGGCGAAACATTACCCGCAGCGGAAGCGATCATTAACCCTAACTTGCGCGACTG<br>TAATTTCCCGTCGAAATCACTGGCAGGCGTGGGTGTGGCGTTTTATCTGATGCTG<br>GCGCTGCGCACCTTTTTGCGCGATCAGGGCTGGTTTGATGAGCGTGGCATCGCA<br>ATTCCTAACCTGGCAGAACTGCTGGATCTGGTCGCGCTGGGAACAGTGGCGGAC<br>GTCGTGCCGCTGGACGCTAATAATCGCATTCTGACCTGGCAGGGGATGAGTCGC<br>ATCCGTGCCGGAAAGTGCCGTCCAGGGATTAAAGCGCTGCTGGAAGTGGCAAA<br>CCGTGATGCACAAAAACTCGCCGCCAGCGATTTAGGTTTTGCGCTGGGGCCACG<br>TCTCAATGCTGCCGGACGACTGGACGATATGTCCGTCGGTGTGGCGCTCTTGCT<br>GTGCGACAACATCGGCGAAGCGCGCGTGCTGGCAAATGAACTCGATGCGCTAA<br>ACCAGACGCGAAAAGAGATCGAACAAGGAATGCAAGTTGAAGCCCTGACCCTG<br>TGCGAGAAACTGGAGCGAAGTCGCGACACGCTACCCGGCGGTGGCAATGTA<br>TCACCCCGAATGGCATCAGGGCGTTGTCGGTATTCTGGCTTCGCGCATCAAAGA<br>GCGTTTTCACCGTCCGGTTATCGCCTTTGCGCCAGCAGGTGATGGTACGCTGAA<br>AGGTTCAGGTCGCTCCATTCAGGGGCTGCATATGCGTGATGCACTGGAGCGATT<br>AGACACACTCTACCCTGGCATGATACTGAAGTTTGGCGGTCATGCGATGGCGGC<br>GGGTTTGTCGCTGGAAGAGGATAAATTCGAACTCTTTCAACAACGGTTTGGCGA<br>GCTGGTTACCGAGTGGCTGGACCCTTCGCTATTGCAAGGCGAAGTGGTGTCAGA<br>CGGCCCGTTAAGCCCGGCCGAAATGACCATGGAAGTGGCGCAGCTGCTGCGCG<br>ATGCTGGCCCGTGGGGCAGATGTTCCGGAGCCGCTGTTTGATGGTCATTTCC<br>GTCTGCTGCAACAGCGGCTGGTGGGCGAACGTCATTTGAAAGTCATGGTCGAAC<br>CGGTCGGCGGCGGTCCGCTGCTGGATGGTATTGCTTTTAATGTCGATACCGCCCT<br>CTGGCCGGATAACGGCGTGCGCGAAGTGCAACTGGCTTACAAGCTCGATATCAA<br>CGAGTTTCGCGGCAACCGCAGCCTGCAAATTATCATCGACAATATCTGGCCAAT<br>TGGATCCGAATTCGAGCTCCGTCGACAAGCTTGCGGCCGCATGGACAAGAAGT<br>ACAGCATCGGCCTGGACATCGGTACCAACAGCGTGGGCTGGGCCGTGATC<br>ACCGACGAGTACAAGGTGCCCAGCAAGAAGTTCAAGGTGCTGGGCAACAC<br>CGACCGCCACAGCATCAAGAAGAACCTGATCGGCGCCCTGCTGTTCGACAG<br>CGGCGAGACCGCCGAGGCCACCCGCCTGAAGCGCACCGCCCGCCGCCGCT<br>ACACCCGCCGCAAGAACCGCATCTGCTACCTGCAGGAGATCTTCAGCAACG<br>AGATGGCCAAGGTGGACGACAGCTTCTTCCACCGCCTGGAGGAGAGCTTC<br>CTGGTGGAGGAGGACAAGAAGCACGAGCGCCACCCCATCTTCGGCAACAT<br>CGTGGACGAGGTGGCCTACCACGAGAAGTACCCCACCATCTACCACCTGCG<br>CAAGAAGCTGGTGGACAGCACCGACAAGGCCGACCTGCGCCTGATCTACC<br>TGGCCCTGGCCCACATGATCAAGTTCCGCGGCCACTTCCTGATCGAGGGCG<br>ACCTGAACCCCGACAACAGCGACGTGGACAAGCTGTTCATCCAGCTGGTGC<br>AGACCTACAACCAGCTGTTCGAGGAGAACCCCATCAACGCCAGCGGCGTG<br>GACGCCAAGGCCATCCTGAGCGCCCGCCTGAGCAAGAGCCGCCGCCTGGA<br>GAACCTGATCGCCCAGCTGCCCGGCGAGAAGAAGAACGGCCTGTTCGGCA<br>ACCTGATCGCCCTGAGCCTGGGCCTGACCCCCAACTTCAAGAGCAACTTCG<br>ACCTGGCCGAGGACGCCAAGCTGCAGCTGAGCAAGGACACCTACGACGAC<br>GACCTGGACAACCTGCTGGCCCAGATCGGCGACCAGTACGCCGACCTGTTC<br>CTGGCCGCCAAGAACCTGAGCGACGCCATCCTGCTGAGCGACATCCTGCG<br>CGTGAACACCGAGATCACCAAGGCCCCCCTGAGCGCCAGCATGATCAAGC<br>GCTACGACGAGCACCACCAGGACCTGACCCTGCTGAAGGCCCTGGTGCGC<br>CAGCAGCTGCCCGAGAAGTACAAGGAGATCTTCTTCGACCAGAGCAAGAAC<br>GGCTACGCCGGCTACATCGACGGCGGCGCCAGCCAGGAGGAGTTCTACAA<br>GTTCATCAAGCCCATCCTGGAGAAGATGGACGGCACCGAGGAGCTGCTGG<br>TGAAGCTGAACCGCGAGGACCTGCTGCGCAAGCAGCGCACCTTCGACAAC<br>GGCAGCATCCCCCACCAGATCCACCTGGGCGAGCTGCACGCCATCCTGCG<br>CCGCCAGGAGGACTTCTACCCCTTCCTGAAGGACAACCGCGAGAAGATCGA<br>GAAGATCCTGACCTTCCGCATCCCCTACTACGTGGGCCCCCTGGCCCGCGG<br>CAACAGCCGCTTCGCCTGGATGACCCGCAAGAGCGAGGAGACCATCACCC<br>CCTGGAACTTCGAGGAGGTGGTGGACAAGGGCGCCAGCGCCCAGAGCTTC<br>ATCGAGCGCATGACCAACTTCGACAAGAACCTGCCCAACGAGAAGGTGCTG<br>CCCAAGCACAGCCTGCTGTACGAGTACTTCACCGTGTACAACGAGCTGACC<br>AAGGTGAAGTACGTGACCGAGGGCATGCGCAAGCCCGCCTTCCTGAGCGG<br>CGAGCAGAAGAAGGCCATCGTGGACCTGCTGTTCAAGACCAACCGCAAGG<br>TGACCGTGAAGCAGCTGAAGGAGGACTACTTCAAGAAGATCGAGTGCTTCG<br>ACAGCGTGGAGATCAGCGGCGTGGAGGACCGCTTCAACGCCAGCCTGGGC<br>ACCTACCACGACCTGCTGAAGATCATCAAGGACAAGGACTTCCTGGACAAC<br>GAGGAGAACGAGGACATCCTGGAGGACATCGTGCTGACCCTGACCCTGTT<br>CGAGGACCGCGAGATGATCGAGGAGCGCCTGAAGACCTACGCCCACCTGT<br>TCGACGACAAGGTGATGAAGCAGCTGAAGCGCCGCCGCTACACCGGCTGG<br>GGCCGCCTGAGCCGCAAGCTTATCAACGGCATCCGCGACAAGCAGAGCGG<br>CAAGACCATCCTGGACTTCCTGAAGAGCGACGGCTTCGCCAACCGCAACTT<br>CATGCAGCTGATCCACGACGACAGCCTGACCTTCAAGGAGGACATCCAGAA<br>GGCCCAGGTGAGCGGCCAGGGCGACAGCCTGCACGAGCACATCGCCAACC<br>TGGCCGGCAGCCCCGCCATCAAGAAGGGCATCCTGCAGACCGTGAAGGTG<br>GTGGACGAGCTGGTGAAGGTGATGGGCCGCCACAAGCCCGAGAACATCGT<br>GATCGAGATGGCCCGCGAGAACCAGACCACCCAGAAGGGCCAGAAGAACA | |

TABLE 7-continued

| SEQ ID NO | Sequence | Description |
|---|---|---|
| | GCCGCGAGCGCATGAAGCGCATCGAGGAGGGCATCAAGGAGCTGGGCAGC<br>CAGATCCTGAAGGAGCACCCCGTGGAGAACACCCAGCTGCAGAACGAGAA<br>GCTGTACCTGTACTACCTGCAGAACGGCCGCGACATGTACGTGGACCAGGA<br>GCTGGACATCAACCGCCTGAGCGACTACGACGTGGACCACATCGTGCCCCA<br>GAGCTTCCTGAAGGACGACAGCATCGACAACAAGGTGCTGACCCGCAGCG<br>ACAAGAACCGCGGCAAGAGCGACAACGTGCCCAGCGAGGAGGTGGTGAAG<br>AAGATGAAGAACTACTGGCGCCAGCTGCTGAACGCCAAGCTGATCACCCAG<br>CGCAAGTTCGACAACCTGACCAAGGCCGAGCGCGGCGGCCTGAGCGAGCT<br>GGACAAGGCCGGCTTCATCAAGCGCCAGCTGGTGGAGACCCGCCAGATCA<br>CCAAGCACGTGGCCCAGATCCTGGACAGCCGCATGAACACCAAGTACGAC<br>GAGAACGACAAGCTGATCCGCGAGGTGAAGGTGATCACCCTGAAGAGCAA<br>GCTGGTGAGCGACTTCCGCAAGGACTTCCAGTTCTACAAGGTGCGCGAGAT<br>CAACAACTACCACCACGCCCACGACGCCTACCTGAACGCCGTGGTGGGCAC<br>CGCCCTGATCAAGAAGTACCCCAAGCTGGAGAGCGAGTTCGTGTACGGCG<br>ACTACAAGGTGTACGACGTGCGCAAGATGATCGCCAAGAGCGAGCAGGAG<br>ATCGGCAAGGCCACCGCCAAGTACTTCTTCTACAGCAACATCATGAACTTC<br>TTCAAGACCGAGATCACCCTGGCCAACGGCGAGATCCGCAAGCGCCCCCT<br>GATCGAGACCAACGGCGAGACCGGCGAGATCGTGTGGGACAAGGGCCGCG<br>ACTTCGCCACCGTGCGCAAGGTGCTGAGCATGCCCCAGGTGAACATCGTGA<br>AGAAGACCGAGGTGCAGACCGGCGGCTTCAGCAAGGAGAGCATCCTGCCC<br>AAGCGCAACAGCGACAAGCTGATCGCCCGCAAGAAGGACTGGGACCCCAA<br>GAAGTACGGCGGCTTCGACAGCCCCACCGTGGCCTACAGCGTGCTGGTGG<br>TGGCCAAGGTGGAGAAGGGCAAGAGCAAGAAGCTGAAGAGCGTGAAGGAG<br>CTGCTGGGCATCACCATCATGGAGCGCAGCAGCTTCGAGAAGAACCCCATC<br>GACTTCCTGGAGGCCAAGGGCTACAAGGAGGTGAAGAAGGACCTGATCAT<br>CAAGCTGCCCAAGTACAGCCTGTTCGAGCTGGAGAACGGCCGCAAGCGCA<br>TGCTGGCCAGCGCCGGCGAGCTGCAGAAGGGCAACGAGCTGGCCCTGCCC<br>AGCAAGTACGTGAACTTCCTGTACCTGGCCAGCCACTACGAGAAGCTGAAG<br>GGCAGCCCCGAGGACAACGAGCAGAAGCAGCTGTTCGTGGAGCAGCACAA<br>GCACTACCTGGACGAGATCATCGAGCAGATCAGCGAGTTCAGCAAGCGCG<br>TGATCCTGGCCGACGCCAACCTGGACAAGGTGCTGAGCGCCTACAACAAG<br>CACCGCGACAAGCCCATCCGCGAGCAGGCCGAGAACATCATCCACCTGTTC<br>ACCCTGACCAACCTGGGCGCCCCCGCCGCCTTCAAGTACTTCGACACCACC<br>ATCGACCGCAAGCGCTACACCAGCACCAAGGAGGTGCTGGACGCCACCCT<br>GATCCACCAGAGCATCACCGGTCTGTACGAGACCCGCATCGACCTGAGCCA<br>GCTGGGCGGCGACGCGGCCGCACTCGACCTCGAGAAAAGGCCGGCGGCCACG<br>AAAAAGGCCGGCCAGGCAAAAAAGAAAAAGCACCACCACCACCACCACTGA | |
| 18 | MGSSHHHHHHSSGLVPRGSHMASMTGGQQMGRGS<u>VKQQIQLRRREVDETADLPA</u><br><u>ELPPLLRRLYASRGVRSAQELERSVKGMLPWQQLSGVEKAVEILYNAFREGTRIIVV</u><br><u>GDFDADGATSTALSVLAMRSLGCSNIDYLVPNRFEDGYGLSPEVVDQAHARGAQLI</u><br><u>VTVDNGISSHAGVEHARSLGIPVIVTDHHLPGETLPAAEAIINPNLRDCNFPSKSLAG</u><br><u>VGVAFYLMLALRTFLRDQGWFDERGIAIPNLAELLDLVALGTVADVVPLDANNRIL</u><br><u>TWQGMSRIRAGKCRPGIKALLEVANRDAQKLAASDLGFALGPRLNAAGRLDDMSV</u><br><u>GVALLLCDNIGEARVLANELDALNQTRKEIEQGMQVEALTLCEKLERSRDTLPGGL</u><br><u>AMYHPEWHQGVVGILASRIKERFHRPVIAFAPAGDGTLKGSGRSIQGLHMRDALER</u><br><u>LDTLYPGMILKFGGHAMAAGLSLEEDKFELFQQRFGELVTEWLDPSLLQGEVVSDG</u><br><u>PLSPAEMTMEVAQLLRDAGPWGQMFPEPLFDGHFRLLQQRLVGERHLKVMVEPVG</u><br><u>GGPLLDGIAFNVDTALWPDNGVREVQLAYKLDINEFRGNRSLQIIIDNIWPIGSEFEL</u><br>RRQACGRMDKKYSIGLDIGTNSVGWAVITDEYKVPSKKEKVLGNTDRHSIKKN<br>LIGALLFDSGETAEATRLKRTARRRYTRRKNRICYLQEIFSNEMAKVDDSFEHR<br>LEESELVEEDKKHERHPIEGNIVDEVAYHEKYPTIYHLRKKLVDSTDKADLRLI<br>YLALAHMIKERGHFLIEGDLNPDNSDVDKLFIQLVQTYNQLFEENPINASGVDA<br>KAILSARLSKSRRLENLIAQLPGEKKNGLEGNLIALSLGLTPNEKSNFDLAEDAK<br>LQLSKDTYDDDLDNLLAQIGDQYADLFLAAKNLSDAILLSDILRVNTEITKAPLS<br>ASMIKRYDEHHQDLTLLKALVRQQLPEKYKEIFFDQSKNGYAGYIDGGASQEE<br>FYKFIKPILEKMDGTEELLVKLNREDLLRKQRTEDNGSIPHQIHLGELHAILRR<br>QEDFYPFLKDNREKIEKILTFRIPYYVGPLARGNSRFAWMTRKSEETITPWNFE<br>EVVDKGASAQSFIERMTNEDKNLPNEKVLPKHSLLYEYFTVYNELTKVKYVTE<br>GMRKPAELSGEQKKAIVDLLEKTNRKVTVKQLKEDYFKKIECEDSVEISGVED<br>RFNASLGTYHDLLKIIKDKDELDNEENEDILEDIVLTLTLFEDREMIEERLKTYA<br>HLFDDKVMKQLKRRRYTGWGRLSRKLINGIRDKQSGKTILDFLKSDGFANRN<br>FMQLIHDDSLTEKEDIQKAQVSGQGDSLHEHIANLAGSPAIKKGILQTVKVDE<br>LVKVMGRHKPENIVIEMARENQTTQKGQKNSRERMKRIEEGIKELGSQILKEH<br>PVENTQLQNEKLYLYYLQNGRDMYVDQELDINRLSDYDVDHIVPQSFLKDDSI<br>DNKVLTRSDKNRGKSDNVPSEEVVKKMNYWRQLLNAKLITQRKEDNLTKAE<br>RGGLSELDKAGFIKRQLVETRQITKHVAQILDSRMNTKYDENDKLIREVKVITL<br>KSKLVSDFRKDFQFYKVREINNYHHAHDAYLNAVVGTALIKKYPKLESEFVYG<br>DYKVYDVRKMIAKSEQEIGKATAKYFFYSNIMNFFKTEITLANGEIRKRPLIET<br>NGETGEIVWDKGRDFATVRKVLSMPQVNIVKKTEVQTGGFSKESILPKRNSDK<br>LIARKKDWDPKKYGGFDSPTVAYSVLVVAKVEKGKSKKLKSVKELLGITIMER<br>SSFEKNPIDFLEAKGYKEVKKDLIIKLPKYSLFELENGRKRMLASAGELQKGNE<br>LALPSKYVNFLYLASHYEKLKGSPEDNEQKQLFVEQHKHYLDEHEQISEFSKR<br>VILADANLDKVLSAYNKHRDKPIREQAENIIHLFTLTNLGAPAAFKYFDTTIDR<br>KRYTSTKEVLDATLIHQSITGLYETRIDLSQLGGDAAALDLEKRPAATKKAGQA<br>KKKKHHHHHH | Underlining indicates Rec J-Bold indicates SpyCas9 |

TABLE 7-continued

| SEQ ID NO | Sequence | Description |
|---|---|---|
| 19 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCC<u>ATGAG</u><br><u>CACAAAACCACTCTTCCTGTTACGGAAAGCGAAAAAATCCGGTGAACCTGA</u><br><u>CGTCGTCCTGTGGGCAAGCAACGATTTTGAATCGACCTGTGCCACTCTGGACTA</u><br><u>CCTGATCGTTAAGTCAGGTAAAAAACTGAGCAGCTATTTTAAAGCTGTTGCCAC</u><br><u>GAATTTTCCTGTCGTTAATGACCTGCCCGCTGAAGGTGAGATCGATTTTACCTGG</u><br><u>AGTGAACGCTATCAACTCAGCAAAGACTCCATGACATGGGAACTAAAACCGGG</u><br><u>AGCAGCACCAGACAACGCTCACTATCAAGGCAATACCAACGTCAACGGCAAG</u><br><u>ACATGACTGAGATTGAGGAGAATATGCTACTCCCAATTTCTGGCCAGGAACTGC</u><br><u>CCATTCGTTGGCTTGCTCAACACGGCAGCGAAAAACCGGTAACGCACGTTTCAC</u><br><u>GCGACGGACTCCAGGCATTACACATTGCTCGGGCTGAAGAACTACCGGCTGTTA</u><br><u>CTGCCCTGGCTGTTTCCCACAAAACCAGCCTGCTCGACCCGCTGGAAATTCGCG</u><br><u>AACTCCACAAACTGGTTCGTGACACTGACAAAGTTTTCCCTAATCCTGGTAATTC</u><br><u>AAACCTGGGACTGATAACTGCTTTTTTCGAAGCATACCTGAACGCTGACTACAC</u><br><u>CGATCGAGGACTGCTGACAAAAGAGTGGATGAAGGGTAATCGTGTTTCACACAT</u><br><u>CACTCGCACGGCTTCCGGTGCTAATGCTGGCGGCGGAAACCTCACCGATCGCGG</u><br><u>CGAAGGTTTCGTACACGATCTGACGTCACTGGCGCGCGACGTAGCCACTGGCGT</u><br><u>ACTGGCCCGTTCAATGGATCTGGACATCTATAACCTTCATCCGGCACACGCTAA</u><br><u>ACGCATTGAGGAAATTATCGCTGAAAATAAACCGCCCTTTTCTGTTTTCCGCGAC</u><br><u>AAATTCATCACCATGCCTGGCGGGCTGGATTATTCCCGCGCCATCGTGGTTGCGT</u><br><u>CCGTAAAAGAAGCACCAATTGGGATCGAGGTCATCCCCGCGCACGTCACTGAAT</u><br><u>ATCTGAACAAAGTACTGACTGAAACCGATCATGCCAACCCTGATCCGGAAATCG</u><br><u>TGGATATTGCCTGCGGTCGCTCCTCTGCCCCGATGCCGCAGCGAGTAACAGAAG</u><br><u>AAGGAAAACAGGATGATGAAGAAAAACCGCAACCATCTGGAACAACGGCAGTT</u><br><u>GAACAGGGAGAGGCTGAAACAATGGAACCGGACGCAACTGAACATCATCAGGA</u><br><u>CACGCAGCCGCTGGATGCTCAGTCACAGGTAAATTCTGTTGATGCGAAATATCA</u><br><u>GGAACTGCGGGCAGAACTCCATGAAGCCCGAAAAACATTCCATCAAAAAATC</u><br><u>CTGTCGATGACGATAAATTGCTTGCTGCATCACGTGGTGAATTTGTTGACGGAA</u><br><u>TTAGCGACCCGAACGATCCGAAATGGGTAAAGGGGATCCAGACTCGCGATTGT</u><br><u>GTGTACCAGAACCAGCCAGAAACGGAAAAAACCAGCCCAGATATGAATCAACC</u><br><u>TGAGCCAGTAGTGCAACAGGAACCGGAAATAGCCTGCAATGCCTGCGGCCAGA</u><br><u>CTGGCGGGGATAACTGCCCTGACTGTGGTGCGGTGATGGGCGACGCAACATACC</u><br><u>AGGAAACATTCGATGAAGAGAGTCAGGTTGAAGCTAAGGAAATGATCCGGAG</u><br><u>GAAATGGAAGGCGCTGAACATCCGCACAATGAGAATGCTGGCAGCGATCCGCA</u><br><u>TCGCGATTGCAGTGATGAAACTGGCGAAGTCGCAGATCCCGTAATCGTAGAAGA</u><br><u>CATAGAGCCAGGTATTTATTACGGAATTTCGAATGAGAATTACCACGCGGGTCC</u><br><u>CGGTATCAGTAAGTCTCAGCTCGATGACATTGCTGATACTCCGGCACTATATTTG</u><br><u>TGGCGTAAAAATGCCCCCGTGGACACCACAAAGACAAAAACGCTCGATTTAGG</u><br><u>AACTGCTTTCCACTGCCGGGTACTTGAACCGGAAGAATTCAGTAACCGCTTTAT</u><br><u>CGTAGCACCTGAATTTAACCGCCGTACAAACGCCGGAAAAGAAGAAGAGAAAG</u><br><u>CGTTTCTGATGGAATGCGCAAGCACAGGAAAAACGGTTATCACTCGGAAGAA</u><br><u>GGCCGGAAAATTGAACTCATGTATCAAAGCGTTATGGCTTTGCCGCTGGGGCAA</u><br><u>TGGCTTGTTGAAAGCGCCGGACACGCTGAATCATCAATTTACTGGGAAGATCCT</u><br><u>GAAACAGGAATTTTGTGTCGGTGCCGTCCGGACAAAATTATCCCTGAATTTCAC</u><br><u>TGGATCATGGACGTGAAAACTACGGCGGATATTCAACGATTCAAAACCGCTTAT</u><br><u>TACGACTACCGCTATCACGTTCAGGATGCATTCTACAGTGACGGTTATGAAGCA</u><br><u>CAGTTTGGAGTGCAGCCAACTTTCGTTTTTCTGGTTGCCAGCACAACTATTGAAT</u><br><u>GCGGACGTTATCCGGTTGAAATTTTCATGATGGGCGAAGAAGCAAACTGGCAG</u><br><u>GTCAACAGGAATATCACCGCAATCTGCGAACCCTGTCTGACTGCCTGAATACCG</u><br><u>ATGAATGGCCAGCTATTAAGACATTATCACTGCCCCGCTGGGCTAAGGAATATG</u><br><u>CAAATGACGGATCCGAATTCGAGCTCCGTCGACAAGCTTGCGGCCGC</u>ATGGAC<br>AAGAAGTACAGCATCGGCCTGGACATCGGTACCAACAGCGTGGGCTGGGC<br>CGTGATCACCGACGAGTACAAGGTGCCAGCAAGAAGTTCAAGGTGCTGG<br>GCAACACCGACCGCCACAGCATCAAGAAGAACCTGATCGGCGCCCTGCTGT<br>TCGACAGCGGCGAGACCGCCGAGGCCACCCGCCTGAAGCGCACCGCCCGC<br>CGCCGCTACACCCGCCGCAAGAACCGCATCTGCTACCTGCAGGAGATCTTC<br>AGCAACGAGATGGCCAAGGTGGACGACAGCTTCTTCCACCGCCTGGAGGA<br>GAGCTTCCTGGTGGAGGAGGACAAGAAGCACGAGCGCCACCCCATCTTCG<br>GCAACATCGTGGACGAGGTGGCCTACCACGAGAAGTACCCCACCATCTACC<br>ACCTGCGCAAGAAGCTGGTGGACAGCACCGACAAGGCCGACCTGCGCCTG<br>ATCTACCTGGCCCTGGCCCACATGATCAAGTTCCGCGGCCACTTCCTGATC<br>GAGGGCGACCTGAACCCCGACAACAGCGACGTGGACAAGCTGTTCATCCA<br>GCTGGTGCAGACCTACAACCAGCTGTTCGAGGAGAACCCCATCAACGCCAG<br>CGGCGTGGACGCCAAGGCCATCCTGAGCGCCCGCCTGAGCAAGAGCCGCC<br>GCCTGGAGAACCTGATCGCCCAGCTGCCCGGCGAGAAGAAGAACGGCCTG<br>TTCGGCAACCTGATCGCCCTGAGCCTGGGCCTGACCCCCAACTTCAAGAGC<br>AACTTCGACCTGGCCGAGGACGCCAAGCTGCAGCTGAGCAAGGACACCTA<br>CGACGACGACCTGGACAACCTGCTGGCCCAGATCGGCGACCAGTACGCCG<br>ACCTGTTCCTGGCCGCCAAGAACCTGAGCGACGCCATCCTGCTGAGCGACA<br>TCCTGCGCGTGAACACCGAGATCACCAAGGCCCCCCTGAGCGCCAGCATG<br>ATCAAGCGCTACGACGAGCACCACCAGGACCTGACCCTGCTGAAGGCCCT<br>GGTGCGCCAGCAGCTGCCCGAGAAGTACAAGGAGATCTTCTTCGACCAGA<br>GCAAGAACGGCTACGCCGGCTACATCGACGGCGGCGCCAGCCAGGAGGAG<br>TTCTACAAGTTCATCAAGCCCATCCTGGAGAAGATGGACGGCACCGAGGAG<br>CTGCTGGTGAAGCTGAACCGCGAGGACCTGCTGCGCAAGCAGCGCACCTT | Underlining indicates Rec E-Bold indicates SpyCas9 |

TABLE 7-continued

| SEQ ID NO | Sequence | Description |
|---|---|---|
| | CGACAACGGCAGCATCCCCCACCAGATCCACCTGGGCGAGCTGCACGCCA<br>TCCTGCGCCGCCAGGAGGACTTCTACCCCTTCCTGAAGGACAACCGCGAGA<br>AGATCGAGAAGATCCTGACCTTCCGCATCCCCTACTACGTGGGCCCCCTGG<br>CCCGCGGCAACAGCCGCTTCGCCTGGATGACCCGCAAGAGCGAGGAGACC<br>ATCACCCCCTGGAACTTCGAGGAGGTGGTGGACAAGGGCGCCAGCGCCCA<br>GAGCTTCATCGAGCGCATGACCAACTTCGACAAGAACCTGCCCAACGAGAA<br>GGTGCTGCCCAAGCACAGCCTGCTGTACGAGTACTTCACCGTGTACAACGA<br>GCTGACCAAGGTGAAGTACGTGACCGAGGGCATGCGCAAGCCCGCCTTCC<br>TGAGCGGCGAGCAGAAGAAGGCCATCGTGGACCTGCTGTTCAAGACCAAC<br>CGCAAGGTGACCGTGAAGCAGCTGAAGGAGGACTACTTCAAGAAGATCGA<br>GTGCTTCGACAGCGTGGAGATCAGCGGCGTGGAGGACCGCTTCAACGCCA<br>GCCTGGGCACCTACCACGACCTGCTGAAGATCATCAAGGACAAGGACTTCC<br>TGGACAACGAGGAGAACGAGGACATCCTGGAGGACATCGTGCTGACCCTG<br>ACCCTGTTCGAGGACCGCGAGATGATCGAGGAGCGCCTGAAGACCTACGC<br>CCACCTGTTCGACGACAAGGTGATGAAGCAGCTGAAGCGCCGCCGCTACA<br>CCGGCTGGGGCCGCCTGAGCCGCAAGCTTATCAACGGCATCCGCGACAAG<br>CAGAGCGGCAAGACCATCCTGGACTTCCTGAAGAGCGACGGCTTCGCCAA<br>CCGCAACTTCATGCAGCTGATCCACGACGACAGCCTGACCTTCAAGGAGGA<br>CATCCAGAAGGCCCAGGTGAGCGGCCAGGGCGACAGCCTGCACGAGCACA<br>TCGCCAACCTGGCCGGCAGCCCCGCCATCAAGAAGGGCATCCTGCAGACC<br>GTGAAGGTGGTGGACGAGCTGGTGAAGGTGATGGGCCGCCACAAGCCCGA<br>GAACATCGTGATCGAGATGGCCCGCGAGAACCAGACCACCCAGAAGGGCC<br>AGAAGAACAGCCGCGAGCGCATGAAGCGCATCGAGGAGGGCATCAAGGAG<br>CTGGGCAGCCAGATCCTGAAGGAGCACCCCGTGGAGAACACCCAGCTGCA<br>GAACGAGAAGCTGTACCTGTACTACCTGCAGAACGGCCGCGACATGTACGT<br>GGACCAGGAGCTGGACATCAACCGCCTGAGCGACTACGACGTGGACCACA<br>TCGTGCCCCAGAGCTTCCTGAAGGACGACAGCATCGACAACAAGGTGCTGA<br>CCCGCAGCGACAAGAACCGCGGCAAGAGCGACAACGTGCCCAGCGAGGAG<br>GTGGTGAAGAAGATGAAGAACTACTGGCGCCAGCTGCTGAACGCCAAGCT<br>GATCACCCAGCGCAAGTTCGACAACCTGACCAAGGCCGAGCGCGGCGGCC<br>TGAGCGAGCTGGACAAGGCCGGCTTCATCAAGCGCCAGCTGGTGGAGACC<br>CGCCAGATCACCAAGCACGTGGCCCAGATCCTGGACAGCCGCATGAACAC<br>CAAGTACGACGAGAACGACAAGCTGATCCGCGAGGTGAAGGTGATCACCC<br>TGAAGAGCAAGCTGGTGAGCGACTTCCGCAAGGACTTCCAGTTCTACAAGG<br>TGCGCGAGATCAACAACTACCACCACGCCCACGACGCCTACCTGAACGCCG<br>TGGTGGGCACCGCCCTGATCAAGAAGTACCCCAAGCTGGAGAGCGAGTTC<br>GTGTACGGCGACTACAAGGTGTACGACGTGCGCAAGATGATCGCCAAGAG<br>CGAGCAGGAGATCGGCAAGGCCACCGCCAAGTACTTCTTCTACAGCAACAT<br>CATGAACTTCTTCAAGACCGAGATCACCCTGGCCAACGGCGAGATCCGCAA<br>GCGCCCCCTGATCGAGACCAACGGCGAGACCGGCGAGATCGTGTGGGACA<br>AGGGCCGCGACTTCGCCACCGTGCGCAAGGTGCTGAGCATGCCCCAGGTG<br>AACATCGTGAAGAAGACCGAGGTGCAGACCGGCGGCTTCAGCAAGGAGAG<br>CATCCTGCCCAAGCGCAACAGCGACAAGCTGATCGCCCGCAAGAAGGACT<br>GGGACCCCAAGAAGTACGGCGGCTTCGACAGCCCCACCGTGGCCTACAGC<br>GTGCTGGTGGTGGCCAAGGTGGAGAAGGGCAAGAGCAAGAAGCTGAAGAG<br>CGTGAAGGAGCTGCTGGGCATCACCATCATGGAGCGCAGCAGCTTCGAGA<br>AGAACCCCATCGACTTCCTGGAGGCCAAGGGCTACAAGGAGGTGAAGAAG<br>GACCTGATCATCAAGCTGCCCAAGTACAGCCTGTTCGAGCTGGAGAACGGC<br>CGCAAGCGCATGCTGGCCAGCGCCGGCGAGCTGCAGAAGGGCAACGAGCT<br>GGCCCTGCCCAGCAAGTACGTGAACTTCCTGTACCTGGCCAGCCACTACGA<br>GAAGCTGAAGGGCAGCCCCGAGGACAACGAGCAGAAGCAGCTGTTCGTGG<br>AGCAGCACAAGCACTACCTGGACGAGATCATCGAGCAGATCAGCGAGTTCA<br>GCAAGCGCGTGATCCTGGCCGACGCCAACCTGGACAAGGTGCTGAGCGCC<br>TACAACAAGCACCGCGACAAGCCCATCCGCGAGCAGGCCGAGAACATCAT<br>CCACCTGTTCACCCTGACCAACCTGGGCGCCCCCGCCGCCTTCAAGTACTT<br>CGACACCACCATCGACCGCAAGCGCTACACCAGCACCAAGGAGGTGCTGG<br>ACGCCACCCTGATCCACCAGAGCATCACCGGTCTGTACGAGACCCGCATCG<br>ACCTGAGCCAGCTGGGCGGCGACGCGGCCGCACTCGACCTCGAGAAAGGCC<br>GGCGGCCACGAAAAAGGCCGGCCAGGCAAAAAAGAAAAAGCACCACCACCAC<br>CACCACTGA | |
| 20 | MGSSHHHHHHSSGLVPRGSHMASMTGGQQMGRGS<u>MSTKPLFLLRKAKKSSGEPD</u><br><u>VVLWASNDFESTCATLDYLIVKSGKKLSSYFKAVATNFPVVNDLPAEGEIDFTWSE</u><br><u>RYQLSKDSMTWELKPGAAPDNAHYQGNTNVNGEDMTEIEENMLLPISGQELPIRW</u><br><u>LAQHGSEKPVTHVSRDGLQALHIARAEELPAVTALAVSHKTSLLDPLEIRELHKLVR</u><br><u>DTDKVFPNPNGNSLGLITAFFEAYLNADYTDRGLLTKEWMKGNRVSHITRTASGAN</u><br><u>AGGGNLTDRGEGFVHDLTSLARDVATGVLARSMDLDIYNLHPAHAKRIEEIIAENK</u><br><u>PPFSVFRDKFITMPGGLDYSRAIVVASVKEAPIGIEVIPAHVTEYLNKVLTETDHANP</u><br><u>DPEIVDIACGRSSAPMPQRVTEEGKQDDEEKPQPSGTTAVEQGEAETMEPDATEHH</u><br><u>QDTQPLDAQSQVNSVDAKYQELRAELHEARKNIPSKNPVDDDKLLAASRGEFVDGI</u><br><u>SDPNDPKWVKGIQTRDCVYQNQPETEKTSPDMNQPEPVVQQEPEIACNACGQTGG</u><br><u>DNCPDCGAVMGDATYQETFDEESQVEAKENDPEEMEGAEHPHNENAGSDPHRDCS</u><br><u>DETGEVADPVIVEDIEPGIYYGISNENYHAGPGISKSQLDDIADTPALYLWRKNAPV</u><br><u>DTTKTKTLDLGTAFHCRVLEPEEFSNRFIVAPEFNRRTNAGKEEEKAFLMECASTGK</u><br><u>TVITAEEGRKIELMYQSVMALPLGQWLVESAGHAESSIYWEDPETGILCRCRPDKIIP</u><br><u>EFHWIMDVKTTADIQRFKTAYYDYRYHVQDAFYSDGYEAQFGVQPTFVFLVASTTI</u> | Underlining indicates Rec E-Bold indicates SpyCas9 |

| SEQ ID NO | Sequence | Description |
|---|---|---|
| | ECGRYPVEIFMMGEEAKLAGQQEYHRNLRTLSDCLNTDEWPAIKTLSLPRWAKEY<br>ANDGSEFELRRQACGRMDKKYSIGLDIGTNSVGWAVITDEYKVPSKKFKVLGNT<br>DRHSIKKNLIGALLFDSGETAEATRLKRTARRRYTRRKNRICYLQEIFSNEMAK<br>VDDSPIIIRLEESFLVEEDKKHERHPIFGNIVDEVAYHEKYPTIYHLRKKLVDST<br>DKADLRLIYLALAHMIKFRGHFLIEGDLNPDNSDVDKLFIQLVQTYNQLFEENP<br>INASGVDAKAILSARLSKSRRLENLIAQLPGEKKNGLFGNLIALSLGLTPNFKSN<br>FDLAEDAKLQLSKDTYDDDLDNLLAQIGDQYADLFLAAKNLSDAILLSDILRVN<br>TEITKAPLSASMIKRYDEHHQDLTLLKALVRQQLPEKYKEIFFDQSKNGYAGYI<br>DGGASQEEFYKFIKPILEKMDGTEELLVKLNREDLLRKQRTFDNGSIPHQIHLG<br>ELHAILRRQEDFYPFLKDNREKIEKILTFRIPYYVGPLARGNSRFAWMTRKSEE<br>TITPWNFEEVVDKGASAQSFIERMTNFDKNLPNEKVLPKIISLLYEYFTVYNELT<br>KVKYVTEGMRKPAFLSGEQKKAIVDLLFKTNRKVTVKQLKEDYFKKIECFDSV<br>EISGVEDRFNASLGTYHDLLKIIKDKDFLDNEENEDILEDIVLTLTLFEDREMIE<br>ERLKTYAHLFDDKVMKQLKRRRYTGWGRLSRKLINGIRDKQSGKTILDFLKS<br>DGFANRNFMQLIHDDSLTFKEDIQKAQVSGQGDSLHEHIANLAGSPAIKKGILQ<br>TVKVVDELVKVMGRHKPENIVIEMARENQTTQKGQKNSRERMKRIEEGIKEL<br>GSQILKEHPVENTQLQNEKLYLYYLQNGRDMYVDQELDINRLSDYDVDHIVPQ<br>SFLKDDSIDNKVLTRSDKNRGKSDNVPSEEVVKKMKNYWRQLLNAKLITQRKF<br>DNLTKAERGGLSELDKAGFIKRQLVETRQITKHVAQILDSRMNTKYDENDKLI<br>REVKVITLKSKLVSDFRKDFQFYKVREINNYHHAHDAYLNAVVGTALIKKYPK<br>LESEFVYGDYKVYDVRKMIAKSEQEIGKATAKYFFYSNIMNPIRTEITLANGEI<br>RKRPLIETNGETGEIVWDKGRDFATVRKVLSMPQVNIVKKTEVQTGGPSKESI<br>LPKRNSDKLIARKKDWDPKKYGGFDSPTVAYSVLVVAKVEKGKSKKLKSVKE<br>LLGITIMERSSFEKNPIDFLEAKGYKEVKKDLIIKLPKYSLFELENGRKRMLASA<br>GELQKGNELALPSKYVNFLYLASHYEKLKGSPEDNEQKQLFVEQHKHYLDEII<br>EQISEFSKRVILADANLDKVLSAYNKHRDKPIREQAENIIHLFTLTNLGAPAAFK<br>YFDTTIDRKRYTSTKEVLDATLIHQSITGLYETRIDLSQLGGDAAALDLEKRPAA<br>TKKAGQAKKKKHHHHHH | |
| 21 | ATGGGCAGCAGCCATCATCATCATCATCACAGCAGCGGCCTGGTGCCGCGCGG<br>AGCCATATGGCTAGCATGACTGGTGGACAGCAAATGGGTCGCGGATCC<u>ATGAGT<br>AAAGGAGAAGAACTTTTCACTGGAGTTGTCCCAATTCTTGTTGAATTAGATGGT<br>GATGTTAATGGGCACAAATTTTCTGTCAGTGGAGAGGGTGAAGGTGATGCAACA<br>TACGGAAAACTTACCCTTAAATTTATTTGCACTACTGGAAAACTACCTGTTCCAT<br>GGCCAACACTTGTCACTACTTTCTCTTATGGTGTTCAATGCTTTTCAAGATACCC<br>AGATCATATGAAGCGGCACGACTTCTTCAAGAGCGCCATGCCTGAGGGATACGT<br>GCAGGAGAGGACCATCTCTTTCAAGGACGACGGGAACTACAAGACACGTGCTG<br>AAGTCAAGTTTGAGGGAGACACCCTCGTCAACAGGATCGAGCTTAAGGGAATC<br>GATTTCAAGGAGGACGGAAACATCCTCGGCCACAAGTTGGAATACAACTACAA<br>CTCCCACAACGTATACATCACGGCAGACAAACAAAAGAATGGAATCAAAGCTA<br>ACTTCAAAATTAGACACAACATTGAAGATGGAAGCGTTCAACTAGCAGACCATT<br>ATCAACAAAATACTCCAATTGGCGATGCCCTGTCCTTTTACCAGACAACCATT<br>ACCTGTCCACACAATCTGCCCTTTCGAAAGATCCCAACGAAAAGAGAGACCACA<br>TGGTCCTTCTTGAGTTTGTAACAGCTGCTGGGATTACACATGGCATGGATGAACT<br>ATACAAA</u>GGATCCGAATTCGAGCTCCGTCGACAAGCTTGCGGCCGC**ATGGACA<br>AGAAGTACAGCATCGGCCTGGACATCGGTACCAACAGCGTGGGCTGGGCC<br>GTGATCACCGACGAGTACAAGGTGCCCAGCAAGAAGTTCAAGGTGCTGGG<br>CAACACCGACCGCCACAGCATCAAGAAGAACCTGATCGGCGCCCTGCTGTT<br>CGACAGCGGCGAGACCGCCGAGGCCACCCGCCTGAAGCGCACCGCCCGCC<br>GCCGCTACACCCGCCGCAAGAACCGCATCTGCTACCTGCAGGAGATCTTCA<br>GCAACGAGATGGCCAAGGTGGACGACAGCTTCTTCCACCGCCTGGAGGAG<br>AGCTTCCTGGTGGAGGAGGACAAGAAGCACGAGCGCCACCCCATCTTCGG<br>CAACATCGTGGACGAGGTGGCCTACCACGAGAAGTACCCCACCATCTACCA<br>CCTGCGCAAGAAGCTGGTGGACAGCACCGACAAGGCCGACCTGCGCCTGA<br>TCTACCTGGCCCTGGCCCACATGATCAAGTTCCGCGGCCACTTCCTGATCG<br>AGGGCGACCTGAACCCCGACAACAGCGACGTGGACAAGCTGTTCATCCAG<br>CTGGTGCAGACCTACAACCAGCTGTTCGAGGAGAACCCCATCAACGCCAGC<br>GGCGTGGACGCCAAGGCCATCCTGAGCGCCCGCCTGAGCAAGAGCCGCG<br>CCTGGAGAACCTGATCGCCCAGCTGCCCGGCGAGAAGAAGAACGGCCTGT<br>TCGGCAACCTGATCGCCCTGAGCCTGGGCCTGACCCCCAACTTCAAGAGCA<br>ACTTCGACCTGGCCGAGGACGCCAAGCTGCAGCTGAGCAAGGACACCTAC<br>GACGACGACCTGGACAACCTGCTGGCCCAGATCGGCGACCAGTACGCCGA<br>CCTGTTCCTGGCCGCCAAGAACCTGAGCGACGCCATCCTGCTGAGCGACAT<br>CCTGCGCGTGAACACCGAGATCACCAAGGCCCCCCTGAGCGCCAGCATGA<br>TCAAGCGCTACGACGAGCACCACCAGGACCTGACCCTGCTGAAGGCCCTG<br>GTGCGCCAGCAGCTGCCCGAGAAGTACAAGGAGATCTTCTTCGACCAGAG<br>CAAGAACGGCTACGCCGGCTACATCGACGGCGGCGCCAGCCAGGAGGAGT<br>TCTACAAGTTCATCAAGCCCATCCTGGAGAAGATGGACGGCACCGAGGAGC<br>TGCTGGTGAAGCTGAACCGCGAGGACCTGCTGCGCAAGCAGCGCACCTTC<br>GACAACGGCAGCATCCCCCACCAGATCCACCTGGGCGAGCTGCACGCCAT<br>CCTGCGCCGCCAGGAGGACTTCTACCCCTTCCTGAAGGACAACCGCGAGAA<br>GATCGAGAAGATCCTGACCTTCCGCATCCCCTACTACGTGGGCCCCCTGGC<br>CCGCGGCAACAGCCGCTTCGCCTGGATGACCCGCAAGAGCGAGGAGACCA<br>TCACCCCCTGGAACTTCGAGGAGGTGGTGGACAAGGGCGCCAGCGCCCAG<br>AGCTTCATCGAGCGCATGACCAACTTCGACAAGAACCTGCCCAACGAGAAG<br>GTGCTGCCCAAGCACAGCCTGCTGTACGAGTACTTCACCGTGTACAACGAG | Underlining indicates GFP-Bold indicates SpyCas9 |

TABLE 7-continued

| SEQ ID NO | Sequence | Description |
|---|---|---|
| | CTGACCAAGGTGAAGTACGTGACCGAGGGCATGCGCAAGCCCGCCTTCCT GAGCGGCGAGCAGAAGAAGGCCATCGTGGACCTGCTGTTCAAGACCAACC GCAAGGTGACCGTGAAGCAGCTGAAGGAGGACTACTTCAAGAAGATCGAG TGCTTCGACAGCGTGGAGATCAGCGGCGTGGAGGACCGCTTCAACGCCAG CCTGGGCACCTACCACGACCTGCTGAAGATCATCAAGGACAAGGACTTCCT GGACAACGAGGAGAACGAGGACATCCTGGAGGACATCGTGCTGACCCTGA CCCTGTTCGAGGACCGCGAGATGATCGAGGAGCGCCTGAAGACCTACGCC CACCTGTTCGACGACAAGGTGATGAAGCAGCTGAAGCGCCGCCGCTACAC CGGCTGGGGCCGCCTGAGCCGCAAGCTTATCAACGGCATCCGCGACAAGC AGAGCGGCAAGACCATCCTGGACTTCCTGAAGAGCGACGGCTTCGCCAAC CGCAACTTCATGCAGCTGATCCACGACGACAGCCTGACCTTCAAGGAGGAC ATCCAGAAGGCCCAGGTGAGCGGCCAGGGCGACAGCCTGCACGAGCACAT CGCCAACCTGGCCGGCAGCCCCGCCATCAAGAAGGGCATCCTGCAGACCG TGAAGGTGGTGGACGAGCTGGTGAAGGTGATGGGCCGCCACAAGCCCGAG AACATCGTGATCGAGATGGCCCGCGAGAACCAGACCACCCAGAAGGGCCA GAAGAACAGCCGCGAGCGCATGAAGCGCATCGAGGAGGGCATCAAGGAGC TGGGCAGCCAGATCCTGAAGGAGCACCCCGTGGAGAACACCCAGCTGCAG AACGAGAAGCTGTACCTGTACTACCTGCAGAACGGCCGCGACATGTACGTG GACCAGGAGCTGGACATCAACCGCCTGAGCGACTACGACGTGGACCACAT CGTGCCCCAGAGCTTCCTGAAGGACGACAGCATCGACAACAAGGTGCTGA CCCGCAGCGACAAGAACCGCGGCAAGAGCGACAACGTGCCCAGCGAGGAG GTGGTGAAGAAGATGAAGAACTACTGGCGCCAGCTGCTGAACGCCAAGCT GATCACCCAGCGCAAGTTCGACAACCTGACCAAGGCCGAGCGCGGCGGCC TGAGCGAGCTGGACAAGGCCGGCTTCATCAAGCGCCAGCTGGTGGAGACC CGCCAGATCACCAAGCACGTGGCCCAGATCCTGGACAGCCGCATGAACAC CAAGTACGACGAGAACGACAAGCTGATCCGCGAGGTGAAGGTGATCACCC TGAAGAGCAAGCTGGTGAGCGACTTCCGCAAGGACTTCCAGTTCTACAAGG TGCGCGAGATCAACAACTACCACCACGCCCACGACGCCTACCTGAACGCCG TGGTGGGCACCGCCCTGATCAAGAAGTACCCCAAGCTGGAGAGCGAGTTC GTGTACGGCGACTACAAGGTGTACGACGTGCGCAAGATGATCGCCAAGAG CGAGCAGGAGATCGGCAAGGCCACCGCCAAGTACTTCTTCTACAGCAACAT CATGAACTTCTTCAAGACCGAGATCACCCTGGCCAACGGCGAGATCCGCAA GCGCCCCCTGATCGAGACCAACGGCGAGACCGGCGAGATCGTGTGGGACA AGGGCCGCGACTTCGCCACCGTGCGCAAGGTGCTGAGCATGCCCCAGGTG AACATCGTGAAGAAGACCGAGGTGCAGACCGGCGGCTTCAGCAAGGAGAG CATCCTGCCCAAGCGCAACAGCGACAAGCTGATCGCCCGCAAGAAGGACT GGGACCCCAAGAAGTACGGCGGCTTCGACAGCCCCACCGTGGCCTACAGC GTGCTGGTGGTGGCCAAGGTGGAGAAGGGCAAGAGCAAGAAGCTGAAGAG CGTGAAGGAGCTGCTGGGCATCACCATCATGGAGCGCAGCAGCTTCGAGA AGAACCCCATCGACTTCCTGGAGGCCAAGGGCTACAAGGAGGTGAAGAAG GACCTGATCATCAAGCTGCCCAAGTACAGCCTGTTCGAGCTGGAGAACGGC CGCAAGCGCATGCTGGCCAGCGCCGGCGAGCTGCAGAAGGGCAACGAGCT GGCCCTGCCCAGCAAGTACGTGAACTTCCTGTACCTGGCCAGCCACTACGA GAAGCTGAAGGGCAGCCCCGAGGACAACGAGCAGAAGCAGCTGTTCGTGG AGCAGCACAAGCACTACCTGGACGAGATCATCGAGCAGATCAGCGAGTTCA GCAAGCGCGTGATCCTGGCCGACGCCAACCTGGACAAGGTGCTGAGCGCC TACAACAAGCACCGCGACAAGCCCATCCGCGAGCAGGCCGAGAACATCAT CCACCTGTTCACCCTGACCAACCTGGGCGCCCCCGCCGCCTTCAAGTACTT CGACACCACCATCGACCGCAAGCGCTACACCAGCACCAAGGAGGTGCTGG ACGCCACCCTGATCCACCAGAGCATCACCGGTCTGTACGAGACCCGCATCG ACCTGAGCCAGCTGGGCGGCGACGCGGCCGCACTCGACCTCGAGAAAGGC CGGCGGCCACGAAAAGGCCGGCCAGCAAAAAGAAAAAGCACCACCACCAC CACCACTGA | |
| 22 | MGSSHHHHHSSGLVPRGSHMASMTGGQQMGRGS<u>MSKGEELFTGVVPILVELDG DVNGHKFSVSGEGEGDATYGKLTLKFICTTGKLPVPWPTLVTTFSYGVQCFSRYPD HMKRHDFFKSAMPEGYVQERTISFKDDGNYKTRAEVKFEGDTLVNRIELKGIDFKE DGNILGHKLEYNYNSHNVYITADKQKNGIKANFKIRHNIEDGSVQLADHYQQNTPI GDGPVLLPDNHYLSTQSALSKDPNEKRDHMVLLEFVTAAGITHGMDELYK</u>GSEFEL RRQACGRMDKKYSIGLDIGTNSVGWAVITDEYKVPSKKEKVLGNTDRHSIKKN LIGALLFDSGETAEATRLKRTARRRYTRRKNRICYLQEIFSNEMAKVDDSFEHR LEESELVEEDKKHERHPIEGNIVDEVAYHEKYPTIYHLRKKLVDSTDKADLRLI YLALAHMIKERGHFLIEGDLNPDNSDVDKLFIQLVQTYNQLFEENPINASGVDA KAILSARLSKSRRLENLIAQLPGEKKNGLEGNLIALSLGLTPNFKSNFDLAEDAK LQLSKDTYDDDLDNLLAQIGDQYADLFLAAKNLSDAILLSDILRVNTEITKAPLS ASMIKRYDEHHQDLTLLKALVRQQLPEKYKEIFFDQSKNGYAGYIDGGASQEE FYKFIKPILEKMDGTEELLVKLNREDLLRKQRTEDNGSIPHQIHLGELHAILRR QEDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYVTE GMRKPAELSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANRN FMQLIHDDSLTEKEDIQKAQVSGQGDSLHEHIANLAGSPAIKKGILQTVKVVDE LVKVMGRHKPENIVIEMARENQTTQKGQKNSRERMKRIEEGIKELGSQILKEH PVENTQLQNEKLYLYYLQNGRDMYVDQELDINRLSDYDVDHIVPQSFLKDDSI DNKVLTRSDKNRGKSDNVPSEEVVKKMKNYWRQLLNAKLITQRKFDNLTKAE | Underlining indicates GFP-Bold indicates SpyCas9 |

| SEQ ID NO | Sequence | Description |
|---|---|---|
| | RGGLSELDKAGFIKRQLVETRQITKHVAQILDSRMNTKYDENDKLIREVKVITL<br>KSKLVSDERKDFQFYKVREINNYHHAHDAYLNAVVGTALIKKYPKLESEFVYG<br>DYKVYDVRKMIAKSEQEIGKATAKYFFYSNIMNFEKTEITLANGEIRKRPLIET<br>NGETGEIVWDKGRDFATVRKVLSMPQVNIVKKTEVQTGGFSKESILPKRNSDK<br>LIARKKDWDPKKYGGFDSPTVAYSVLVVAKVEKGKSKKLKSVKELLGITIMER<br>SSFEKNPIDFLEAKGYKEVKKDLIIKLPKYSLFELENGRKRMLASAGELQKGNE<br>LALPSKYVNFLYLASHYEKLKGSPEDNEQKQLFVEQHKHYLDEHEQISEFSKR<br>VILADANLDKVLSAYNKHRDKPIREQAENIIHLFTLTNLGAPAAFKYFDTTIDR<br>KRYTSTKEVLDATLIHQSITGLYETRIDLSQLGGDAAALDLEKRPAATKKAGQA<br>KKKKHHHHHH | |
| 23 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCG<u>ATGGCC</u><br><u>AGCAGAGGCGTAAACAAGGTTATTCTCGTTGGTAATCTGGGTCAGGACCCGGAA</u><br><u>GTACGCTACATGCCAAATGGTGGCCAGTTGCCAACATTACGCTGGCTACTTCC</u><br><u>GAATCCTGGCGTGATAAAGCGACCGGCGAGATGAAAGAACAGACTGAATGGCA</u><br><u>CCGCGTTGCTGTTCGGCAAACTGGCAGAAGTGGCGAGCGAATATCTGCGTAA</u><br><u>AGGTTCTCAGGTTTATATCGAAGGTCAGCTGCGTACCCGTAAATGGACCGATCA</u><br><u>ATCCGGTCAGGATCGCTACACCACAGAAGTCGTGGTGAACGTTGGCGGCACCAT</u><br><u>GCAGATGCTGGGTGGTCGTGGATCCGAATTCGAGCTCCGTCGACAAGCTTGCGG</u><br>CCGCATGGACAAGAAGTACAGCATCGGCCTGGACATCGGTACCAACAGCGT<br>GGGCTGGGCCGTGATCACCGACGAGTACAAGGTGCCCAGCAAGAAGTTCA<br>AGGTGCTGGGCAACACCGACCGCCACAGCATCAAGAAGAACCTGATCGGC<br>GCCCTGCTGTTCGACAGCGGCGAGACCGCCGAGGCCACCCGCCTGAAGCG<br>CACCGCCCGCCGCCGCTACACCCGCCGCAAGAACCGCATCTGCTACCTGCA<br>GGAGATCTTCAGCAACGAGATGGCCAAGGTGGACGACAGCTTCTTCCACCG<br>CCTGGAGGAGAGCTTCCTGGTGGAGGAGGACAAGAAGCACGAGCGCCACC<br>CCATCTTCGGCAACATCGTGGACGAGGTGGCCTACCACGAGAAGTACCCCA<br>CCATCTACCACCTGCGCAAGAAGCTGGTGGACAGCACCGACAAGGCCGAC<br>CTGCGCCTGATCTACCTGGCCCTGGCCCACATGATCAAGTTCCGCGGCCAC<br>TTCCTGATCGAGGGCGACCTGAACCCCGACAACAGCGACGTGGACAAGCT<br>GTTCATCCAGCTGGTGCAGACCTACAACCAGCTGTTCGAGGAGAACCCCAT<br>CAACGCCAGCGGCGTGGACGCCAAGGCCATCCTGAGCGCCCGCCTGAGCA<br>AGAGCCGCCGCCTGGAGAACCTGATCGCCCAGCTGCCCGGCGAGAAGAAG<br>AACGGCCTGTTCGGCAACCTGATCGCCCTGAGCCTGGGCCTGACCCCCAAC<br>TTCAAGAGCAACTTCGACCTGGCCGAGGACGCCAAGCTGCAGCTGAGCAA<br>GGACACCTACGACGACGACCTGGACAACCTGCTGGCCCAGATCGGCGACC<br>AGTACGCCGACCTGTTCCTGGCCGCCAAGAACCTGAGCGACGCCATCCTGC<br>TGAGCGACATCCTGCGCGTGAACACCGAGATCACCAAGGCCCCCCTGAGC<br>GCCAGCATGATCAAGCGCTACGACGAGCACCACCAGGACCTGACCCTGCT<br>GAAGGCCCTGGTGCGCCAGCAGCTGCCCGAGAAGTACAAGGAGATCTTCT<br>TCGACCAGAGCAAGAACGGCTACGCCGGCTACATCGACGGCGGCGCCAGC<br>CAGGAGGAGTTCTACAAGTTCATCAAGCCCATCCTGGAGAAGATGGACGGC<br>ACCGAGGAGCTGCTGGTGAAGCTGAACCGCGAGGACCTGCTGCGCAAGCA<br>GCGCACCTTCGACAACGGCAGCATCCCCCACCAGATCCACCTGGGCGAGCT<br>GCACGCCATCCTGCGCCGCCAGGAGGACTTCTACCCCTTCCTGAAGGACAA<br>CCGCGAGAAGATCGAGAAGATCCTGACCTTCCGCATCCCCTACTACGTGGG<br>CCCCCTGGCCCGCGGCAACAGCCGCTTCGCCTGGATGACCCGCAAGAGCG<br>AGGAGACCATCACCCCCTGGAACTTCGAGGAGGTGGTGGACAAGGGCGCC<br>AGCGCCCAGAGCTTCATCGAGCGCATGACCAACTTCGACAAGAACCTGCC<br>AACGAGAAGGTGCTGCCCAAGCACAGCCTGCTGTACGAGTACTTCACCGTG<br>TACAACGAGCTGACCAAGGTGAAGTACGTGACCGAGGGCATGCGCAAGCC<br>CGCCTTCCTGAGCGGCGAGCAGAAGAAGGCCATCGTGGACCTGCTGTTCA<br>AGACCAACCGCAAGGTGACCGTGAAGCAGCTGAAGGAGGACTACTTCAAG<br>AAGATCGAGTGCTTCGACAGCGTGGAGATCAGCGGCGTGGAGGACCGCTT<br>CAACGCCAGCCTGGGCACCTACCACGACCTGCTGAAGATCATCAAGGACAA<br>GGACTTCCTGGACAACGAGGAGAACGAGGACATCCTGGAGGACATCGTGC<br>TGACCCTGACCCTGTTCGAGGACCGCGAGATGATCGAGGAGCGCCTGAAG<br>ACCTACGCCCACCTGTTCGACGACAAGGTGATGAAGCAGCTGAAGCGCCG<br>CCGCTACACCGGCTGGGGCCGCCTGAGCCGCAAGCTTATCAACGGCATCC<br>GCGACAAGCAGAGCGGCAAGACCATCCTGGACTTCCTGAAGAGCGACGGC<br>TTCGCCAACCGCAACTTCATGCAGCTGATCCACGACGACAGCCTGACCTTC<br>AAGGAGGACATCCAGAAGGCCCAGGTGAGCGGCCAGGGCGACAGCCTGCA<br>CGAGCACATCGCCAACCTGGCCGGCAGCCCCGCCATCAAGAAGGGCATCC<br>TGCAGACCGTGAAGGTGGTGGACGAGCTGGTGAAGGTGATGGGCCGCCAC<br>AAGCCCGAGAACATCGTGATCGAGATGGCCCGCGAGAACCAGACCACCCA<br>GAAGGGCCAGAAGAACAGCCGCGAGCGCATGAAGCGCATCGAGGAGGGCA<br>TCAAGGAGCTGGGCAGCCAGATCCTGAAGGAGCACCCCGTGGAGAACACC<br>CAGCTGCAGAACGAGAAGCTGTACCTGTACTACCTGCAGAACGGCCGCGA<br>CATGTACGTGGACCAGGAGCTGGACATCAACCGCCTGAGCGACTACGACG<br>TGGACCACATCGTGCCCCAGAGCTTCCTGAAGGACGACAGCATCGACAACA<br>AGGTGCTGACCCGCAGCGACAAGAACCGCGGCAAGAGCGACAACGTGCCC<br>AGCGAGGAGGTGGTGAAGAAGATGAAGAACTACTGGCGCCAGCTGCTGAA<br>CGCCAAGCTGATCACCCAGCGCAAGTTCGACAACCTGACCAAGGCCGAGC<br>GCGGCGGCCTGAGCGAGCTGGACAAGGCCGGCTTCATCAAGCGCCAGCTG<br>GTGGAGACCCGCCAGATCACCAAGCACGTGGCCCAGATCCTGGACAGCCG | Underlining indicates SSB-Bold indicates SpyCas9 |

TABLE 7-continued

| SEQ ID NO | Sequence | Description |
|---|---|---|
| | CATGAACACCAAGTACGACGAGAACGACAAGCTGATCCGCGAGGTGAAGG<br>TGATCACCCTGAAGAGCAAGCTGGTGAGCGACTTCCGCAAGGACTTCCAGT<br>CTCTACAAGGTGCGCGAGATCAACAACTACCACCACGCCCACGACGCCTACC<br>TGAACGCCGTGGTGGGCACCGCCCTGATCAAGAAGTACCCCAAGCTGGAG<br>AGCGAGTTCGTGTACGGCGACTACAAGGTGTACGACGTGCGCAAGATGAT<br>CGCCAAGAGCGAGCAGGAGATCGGCAAGGCCACCGCCAAGTACTTCTTCT<br>ACAGCAACATCATGAACTTCTTCAAGACCGAGATCACCCTGGCCAACGGCG<br>AGATCCGCAAGCGCCCCCTGATCGAGACCAACGGCGAGACCGGCGAGATC<br>GTGTGGGACAAGGGCCGCGACTTCGCCACCGTGCGCAAGGTGCTGAGCAT<br>GCCCCAGGTGAACATCGTGAAGAAGACCGAGGTGCAGACCGGCGGCTTCA<br>GCAAGGAGAGCATCCTGCCCAAGCGCAACAGCGACAAGCTGATCGCCCGC<br>AAGAAGGACTGGGACCCCAAGAAGTACGGCGGCTTCGACAGCCCCACCGT<br>GGCCTACAGCGTGCTGGTGGTGGCCAAGGTGGAGAAGGGCAAGAGCAAGA<br>AGCTGAAGAGCGTGAAGGAGCTGCTGGGCATCACCATCATGGAGCGCAGC<br>AGCTTCGAGAAGAACCCCATCGACTTCCTGGAGGCCAAGGGCTACAAGGA<br>GGTGAAGAAGGACCTGATCATCAAGCTGCCCAAGTACAGCCTGTTCGAGCT<br>GGAGAACGGCCGCAAGCGCATGCTGGCCAGCGCCGGCGAGCTGCAGAAGG<br>GCAACGAGCTGGCCCTGCCCAGCAAGTACGTGAACTTCCTGTACCTGGCCA<br>GCCACTACGAGAAGCTGAAGGGCAGCCCCGAGGACAACGAGCAGAAGCAG<br>CTGTTCGTGGAGCAGCACAAGCACTACCTGGACGAGATCATCGAGCAGATC<br>AGCGAGTTCAGCAAGCGCGTGATCCTGGCCGACGCCAACCTGGACAAGGT<br>GCTGAGCGCCTACAACAAGCACCGCGACAAGCCCATCCGCGAGCAGGCCG<br>AGAACATCATCCACCTGTTCACCCTGACCAACCTGGGCGCCCCCGCCGCCT<br>TCAAGTACTTCGACACCACCATCGACCGCAAGCGCTACACCAGCACCAAGG<br>AGGTGCTGGACGCCACCCTGATCCACCAGAGCATCACCGGTCTGTACGAGA<br>CCCGCATCGACCTGAGCCAGCTGGGCGGCGACGCGGCCGCACTCGACCTCG<br>AGAAAGGCCGGCGGCCACGAAAAGGCCGGCCAGGCAAAAAAGAAAAAGCA<br>CCACCACCACCACCACTGA | |
| 24 | MGSSHHHHHSSGLVPRGSHMASMTGGQQMGRGS<u>MASRGVNKIVILVGNLGQDPE<br>VRYMMPNGGAVANITLATSESWRDKATGEKEQTEWHRVVLFGKLAEVASEYLRK<br>GSQVYIEGQLRTRKWTDQSGQDRYTTEVVVNVGGTMQMLGGRGS</u>EFELRRQACG<br>RMDKKYSIGLDIGTNSVGWAVITDEYKVPSKKFKVLGNTDRHSIKKNLIGALLF<br>DSGETAEATREKRTARRRYTRRKNRICYLQEIFSNEMAKVDDSFEHRLEESELV<br>EEDKKHERHPIEGNIVDEVAYHEKYPTIYHLRKKLVDSTDKADIRLIYEALAH<br>MIKFRGHFLIEGDLNPDNSDVDKLFIQLVQTYNQLFEENPINASGVDAKAILSAR<br>LSKSRRLENLIAQLPGEKKNGLEGNLIALSEGLTPNEKSNFDLAEDAKLQLSKD<br>TYDDDLDNELAQIGDQYADEFLAAKNESDAILLSDILRVNTEITKAPLSASMIKR<br>YDEHHQDLTELKALVRQQLPEKYKEIFFDQSKNGYAGYIDGGASQEEFYKFIK<br>PILEKMDGTEELLVKLNREDLLERKQRTEDNGSIPHQIHLGELHAILRRQEDFYP<br>FLKDNREKIEKILTFRIPYWGPLARGNSRFAWMTRKSEETITPWNFEEVVDKG<br>ASAQSFIERMTNEDKNITNEKVLPKHSLLYEYFTVYNELTKVKYVTEGMRKPA<br>FLSGEQKKAIVDLLEKTNRKVTVKQLKEDYFKKIECEDSVEISGVEDRFNASEG<br>TYHDLLKIIKDKDFLDNEENEDILEDIVLTLTLFEDREMIEERLKTYAHLFDDK<br>VMKQEKRRRYTGWGRLSRKLINGIRDKQSGKTILDFLKSDGFANRNFMQLIH<br>DDSLTFKEDIQKAQVSGQGDSLHEHIANLAGSPAIKKGILQTVKVVDELVKVM<br>GRHKPENIVIEMARENQTTQKGQKNSRERMKRIEEGIKELGSQILKEHPVENT<br>QLQNEKLYLYYLQNGRDMYVDQELDINRLSDYDVDHIVPQSFLKDDSIDNKVL<br>TRSDKNRCKSDNVPSEEVVKKMKNYWRQLLNAKLITQRKFDNLTKAERGGLS<br>ELDKAGFIKRQLVETRQITKHVAQILDSRMNTKYDENDKLIREVKVITLKSKLV<br>SDFRKDFQFYKVREINNYHHAHDAYLNAVVGTALIKKYPKLESEFVYGDYKVY<br>DVRKMIAKSEQEIGKATAKYFFYSNIMNFFKTEITLANGEIRKRPLIETNGETGE<br>IVWDKGRDFATVRKVLSMPQVNIVKKTEVQTGGFSKESILPKRNSDKLIARKK<br>DWDPKKYGGFDSPTVAYSVLVVAKVEKGKSKKLKSVKELLGITIMERSSFEKN<br>PIDFLEAKGYKEVVKKDLIIKLPKYSLFELENGRKRMLASAGELQKGNELALPSK<br>YVNFLYLASHYEKLKGSPEDNEQKQLFVEQHKHYLDEHEQISEFSKRVILADA<br>NLDKVLSAYNKHRDKPIREQAENIIHLFTLTNLGAPAAFKYFDTTIDRKRYTST<br>KEYLDATLIHQSITGLYETRIDLSQLGGDAAALDLEKRPAATKKAGQAKKKKH<br>HHHH | Underlining indicates SSB-Bold indicates spyCas9 |
| 25 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCC<u>ATGGCC<br/>AGCAGAGGCGTAAACAAGGTTATTCTCGTTGGTAATCTGGGTCAGGACCCGGAA<br/>GTACGCTACATGCCAAATGGTGGCGCAGTTGCCAACATTACGCTGGCTACTTCC<br/>GAATCCTGGCGTGATAAAGCGACCGGCGAGATGAAAGAACAGACTGAATGGCA<br/>CCGCGTTGTGCTGTTCGGCAAACTGGCAGAAGTGGCGAGCGAATATCTGCGTAA<br/>AGGTTCTCAGGTTTATATCGAAGGTCAGCTGCGTACCCGTAAATGGACCGATCA<br/>ATCCGGTCAGGATCGCTACACCACAGAAGTCGTGGTGAACGTTGGCGGCACCAT<br/>GCAGATGCTGGGTGGTCGTGGATCCGAATTCGAGCTCCGTCGACAAGCTTGCGG</u><br>CCGCATGGACAAGAAGTACAGCATCGGCCTGGACATCGGTACCAACAGCGT<br>GGGCTGGGCCGTGATCACCGACGAGTACAAGGTGCCCAGCAAGAAGTTCA<br>AGGTGCTGGGCAACACCGACCGCCACAGCATCAAGAAGAACCTGATCGGC<br>GCCCTGCTGTTCGACAGCGGCGAGACCGCCGAGGCCACCCGCCTGAAGCG<br>CACCGCCCGCCGCCGCTACACCCGCCGCAAGAACCGCATCTGCTACCTGCA<br>GGAGATCTTCAGCAACGAGATGGCCAAGGTGGACGACAGCTTCTTCCACCG<br>CCTGGAGGAGAGCTTCCTGGTGGAGGAGGACAAGAAGCACGAGCGCCACC | Underlining indicates SSB-Bold indicates SpyCas9-Italics indicate RecJ |

TABLE 7-continued

| SEQ ID NO | Sequence | Description |
|---|---|---|
| | CCATCTTCGGCAACATCGTGGACGAGGTGGCCTACCACGAGAAGTACCCCA<br>CCATCTACCACCTGCGCAAGAAGCTGGTGGACAGCACCGACAAGGCCGAC<br>CTGCGCCTGATCTACCTGGCCCTGGCCCACATGATCAAGTTCCGCGGCCAC<br>TTCCTGATCGAGGGCGACCTGAACCCCGACAACAGCGACGTGGACAAGCT<br>GTTCATCCAGCTGGTGCAGACCTACAACCAGCTGTTCGAGGAGAACCCCAT<br>CAACGCCAGCGGCGTGGACGCCAAGGCCATCCTGAGCGCCCGCCTGAGCA<br>AGAGCCGCCGCCTGGAGAACCTGATCGCCCAGCTGCCCGGCGAGAAGAAG<br>AACGGCCTGTTCGGCAACCTGATCGCCCTGAGCCTGGGCCTGACCCCCAAC<br>TTCAAGAGCAACTTCGACCTGGCCGAGGACGCCAAGCTGCAGCTGAGCAA<br>GGACACCTACGACGACGACCTGGACAACCTGCTGGCCCAGATCGGCGACC<br>AGTACGCCGACCTGTTCCTGGCCGCCAAGAACCTGAGCGACGCCATCCTGC<br>TGAGCGACATCCTGCGCGTGAACACCGAGATCACCAAGGCCCCCCTGAGC<br>GCCAGCATGATCAAGCGCTACGACGAGCACCACCAGGACCTGACCCTGCT<br>GAAGGCCCTGGTGCGCCAGCAGCTGCCCGAGAAGTACAAGGAGATCTTCT<br>TCGACCAGAGCAAGAACGGCTACGCCGGCTACATCGACGGCGGCGCCAGC<br>CAGGAGGAGTTCTACAAGTTCATCAAGCCCATCCTGGAGAAGATGGACGGC<br>ACCGAGGAGCTGCTGGTGAAGCTGAACCGCGAGGACCTGCTGCGCAAGCA<br>GCGCACCTTCGACAACGGCAGCATCCCCCACCAGATCCACCTGGGCGAGCT<br>GCACGCCATCCTGCGCCGCCAGGAGGACTTCTACCCCTTCCTGAAGGACAA<br>CCGCGAGAAGATCGAGAAGATCCTGACCTTCCGCATCCCCTACTACGTGGG<br>CCCCCTGGCCCGCGGCAACAGCCGCTTCGCCTGGATGACCCGCAAGAGCG<br>AGGAGACCATCACCCCCTGGAACTTCGAGGAGGTGGTGGACAAGGGCGCC<br>AGCGCCCAGAGCTTCATCGAGCGCATGACCAACTTCGACAAGAACCTGCCC<br>AACGAGAAGGTGCTGCCCAAGCACAGCCTGCTGTACGAGTACTTCACCGTG<br>TACAACGAGCTGACCAAGGTGAAGTACGTGACCGAGGGCATGCGCAAGCC<br>CGCCTTCCTGAGCGGCGAGCAGAAGAAGGCCATCGTGGACCTGCTGTTCA<br>AGACCAACCGCAAGGTGACCGTGAAGCAGCTGAAGGAGGACTACTTCAAG<br>AAGATCGAGTGCTTCGACAGCGTGGAGATCAGCGGCGTGGAGGACCGCTT<br>CAACGCCAGCCTGGGCACCTACCACGACCTGCTGAAGATCATCAAGGACAA<br>GGACTTCCTGGACAACGAGGAGAACGAGGACATCCTGGAGGACATCGTGC<br>TGACCCTGACCCTGTTCGAGGACCGCGAGATGATCGAGGAGCGCCTGAAG<br>ACCTACGCCCACCTGTTCGACGACAAGGTGATGAAGCAGCTGAAGCGCCG<br>CCGCTACACCGGCTGGGGCCGCCTGAGCCGCAAGCTTATCAACGGCATCC<br>GCGACAAGCAGAGCGGCAAGACCATCCTGGACTTCCTGAAGAGCGACGGC<br>TTCGCCAACCGCAACTTCATGCAGCTGATCCACGACGACAGCCTGACCTTC<br>AAGGAGGACATCCAGAAGGCCCAGGTGAGCGGCCAGGGCGACAGCCTGCA<br>CGAGCACATCGCCAACCTGGCCGGCAGCCCCGCCATCAAGAAGGGCATCC<br>TGCAGACCGTGAAGGTGGTGGACGAGCTGGTGAAGGTGATGGGCCGCCAC<br>AAGCCCGAGAACATCGTGATCGAGATGGCCCGCGAGAACCAGACCACCCA<br>GAAGGGCCAGAAGAACAGCCGCGAGCGCATGAAGCGCATCGAGGAGGGCA<br>TCAAGGAGCTGGGCAGCCAGATCCTGAAGGAGCACCCCGTGGAGAACACC<br>CAGCTGCAGAACGAGAAGCTGTACCTGTACTACCTGCAGAACGGCCGCGA<br>CATGTACGTGGACCAGGAGCTGGACATCAACCGCCTGAGCGACTACGACG<br>TGGACCACATCGTGCCCCAGAGCTTCCTGAAGGACGACAGCATCGACAACA<br>AGGTGCTGACCCGCAGCGACAAGAACCGCGGCAAGAGCGACAACGTGCCC<br>AGCGAGGAGGTGGTGAAGAAGATGAAGAACTACTGGCGCCAGCTGCTGAA<br>CGCCAAGCTGATCACCCAGCGCAAGTTCGACAACCTGACCAAGGCCGAGC<br>GCGGCGGCCTGAGCGAGCTGGACAAGGCCGGCTTCATCAAGCGCCAGCTG<br>GTGGAGACCCGCCAGATCACCAAGCACGTGGCCCAGATCCTGGACAGCCG<br>CATGAACACCAAGTACGACGAGAACGACAAGCTGATCCGCGAGGTGAAGG<br>TGATCACCCTGAAGAGCAAGCTGGTGAGCGACTTCCGCAAGGACTTCCAGT<br>TCTACAAGGTGCGCGAGATCAACAACTACCACCACGCCCACGACGCCTACC<br>TGAACGCCGTGGTGGGCACCGCCCTGATCAAGAAGTACCCCAAGCTGGAG<br>AGCGAGTTCGTGTACGGCGACTACAAGGTGTACGACGTGCGCAAGATGAT<br>CGCCAAGAGCGAGCAGGAGATCGGCAAGGCCACCGCCAAGTACTTCTTCT<br>ACAGCAACATCATGAACTTCTTCAAGACCGAGATCACCCTGGCCAACGGCG<br>AGATCCGCAAGCGCCCCCTGATCGAGACCAACGGCGAGACCGGCGAGATC<br>GTGTGGGACAAGGGCCGCGACTTCGCCACCGTGCGCAAGGTGCTGAGCAT<br>GCCCCAGGTGAACATCGTGAAGAAGACCGAGGTGCAGACCGGCGGCTTCA<br>GCAAGGAGAGCATCCTGCCCAAGCGCAACAGCGACAAGCTGATCGCCCGC<br>AAGAAGGACTGGGACCCCAAGAAGTACGGCGGCTTCGACAGCCCCACCGT<br>GGCCTACAGCGTGCTGGTGGTGGCCAAGGTGGAGAAGGGCAAGAGCAAGA<br>AGCTGAAGAGCGTGAAGGAGCTGCTGGGCATCACCATCATGGAGCGCAGC<br>AGCTTCGAGAAGAACCCCATCGACTTCCTGGAGGCCAAGGGCTACAAGGA<br>GGTGAAGAAGGACCTGATCATCAAGCTGCCCAAGTACAGCCTGTTCGAGCT<br>GGAGAACGGCCGCAAGCGCATGCTGGCCAGCGCCGGCGAGCTGCAGAAGG<br>GCAACGAGCTGGCCCTGCCCAGCAAGTACGTGAACTTCCTGTACCTGGCCA<br>GCCACTACGAGAAGCTGAAGGGCAGCCCCGAGGACAACGAGCAGAAGCAG<br>CTGTTCGTGGAGCAGCACAAGCACTACCTGGACGAGATCATCGAGCAGATC<br>AGCGAGTTCAGCAAGCGCGTGATCCTGGCCGACGCCAACCTGGACAAGGT<br>GCTGAGCGCCTACAACAAGCACCGCGACAAGCCCATCCGCGAGCAGGCCG<br>AGAACATCATCCACCTGTTCACCCTGACCAACCTGGGCGCCCCCGCCGCCT<br>TCAAGTACTTCGACACCACCATCGACCGCAAGCGCTACACCAGCACCAAGG<br>AGGTGCTGGACGCCACCCTGATCCACCAGAGCATCACCGGTCTGTACGAGA<br>CCCGCATCGACCTGAGCCAGCTGGGCGGCGACGCGGCCGCACTCGACCTGC<br>*AGGTGAAACAACAGATACAACTTCGTCGCCGTGAAGTCGATGAAACGGCAGACTTGC* | |

TABLE 7-continued

| SEQ ID NO | Sequence | Description |
|---|---|---|
| | CCGCTGAATTGCCTCCCTTGCTGCGCCGTTTATACGCCAGCCGGGGAGTACGCAGTG<br>CGCAAGAACTGGAACGCAGTGTTAAAGGTATGCTGCCCTGGCAGCAACTGAGCGGC<br>GTCGAAAAGGCCGTTGAGATCCTTTACAACGCTTTTCGCGAAGGAACGCGGATTATTG<br>TGGTCGGTGATTTCGACGCCGACGGCGCGACCAGCACGGCTCTAAGCGTGCTGGCG<br>ATGCGCTCGCTTGGTTGCAGCAATATCGACTACCTGGTACCAAACCGTTTCGAAGACG<br>GTTACGGCTTAAGCCCGGAAGTGGTCGATCAGGCCCATGCCCGTGGCGCGCAGTTA<br>ATTGTCACGGTGGATAACGGTATTTCCTCCCATGCGGGGGTTGAGCACGCTCGCTCG<br>TTGGGCATCCCGGTTATTGTTACCGATCACCATTTGCCAGGCGACACATTACCCGCAG<br>CGGAAGCGATCATTAACCCTAACTTGCGCGACTGTAATTTCCCGTCGAAATCACTGGC<br>AGGCGTGGGTGTGGCGTTTTATCTGATGCTGGCGCTGCGCACCTTTTTGCGCGATCA<br>GGGCTGGTTTGATGAGCGTAACATCGCAATTCCTAACCTGGCAGAACTGCTGGATCT<br>GGTCGCGCTGGGGACAGTGGCGGACGTCGTGCCGCTGGACGCTAATAATCGCATTC<br>TGACCTGGCAGGGGATGAGTCGCATCCGAGCCGGAAAGTGCGGTCCGGGGATTAAA<br>GCGCTGCTTGAAGTGGCAAACCGTGATGCACAAAAACTCGCCGCCAGCGATTAGGT<br>TTTGCGCTGGGGCCACGTCTCAATGCTGCCGGACGACTGGACGATATGTCCGTCGGT<br>GTGGCGCTGTTGTTGTGCGACAACATCGGCGAAGCGCGCGTGCTGGCAAATGAACT<br>CGATGCGCTAAACCAGACGCGAAAAGAGATCGAACAAGGAATGCAAATTGAAGCCCT<br>GACCCTGTGCGAGAAACTGGAGCGCAGCCGTGACACGCTACCCGGCGGGCTGGCAA<br>TGTATCACCCCGAATGGCATCAGGGCGTTGTCGGTATTCTGGCTTCGCGCATCAAAG<br>AGCGTTTTCACCGTCCGGTTATCGCGTTTGCGCCAGCAGGTGACGGTACGCTGAAAG<br>GTTCCGGTCGCTCCATTCAGGGGCTGCATATGCGTGATGCGCTGGAGCGATTAGACA<br>CACTCTACCCTGGCATGATGCTGAAGTTTGGCGGTCATGCGATGGCGGCGGGTTTGT<br>CGCTGGAAGAGGATAAATTCAAACTCTTTCAACAACGGTTTGGCGAACTGGTTACTGA<br>GTGGCTGGACCCTTCGCTATTGCAAGGCGAAGTGGTATCAGACGGTCCGTTAAGCCC<br>GGCCGAAATGACCATGGAAGTGGCGCAGCTGCTGCGCGATGCTGGCCCGTGGGGG<br>CAGATGTTCCCGGAGCCGCTGTTTGACGGTCATTTCCGTCTGCTGCAACAGCGGCTG<br>GTGGGCGAACGTCATTTGAAGGTGATGGTCGAACCGGTCGGCGGCGGTCCACTGCT<br>GGATGGTATTGCTTTTAATGTCGATACCGCCCTCTGGCCGGATAACGGCGTGCGCGA<br>AGTGCAACTGGCTTATAAGCTCGATATCAACGAGTTTCGCGGCAACCGCAGCCTGCA<br>AATTATCATCGACAATATCTGGCCAATTCTGCAGAAAAGGCCGGCGGCCACGAAAA<br>AGGCCGGCCAGGCAAAAAAGAAAAAGCACCACCACCACCACCACTGA | |
| 26 | MGSSHHHHHHSSGLVPRGSHMASMTGGQQMGRGS<ins>MASRGVNKVILVGNLGQDPE</ins><br><ins>VRYMPNGGAVANITLATSESWRDKATGEMKEQTEWHRVVLFGKLAEVASEYLRK</ins><br><ins>GSQVYIEGQLRTRKWTDQSGQDRYTTEVVVNVGGTMQMLGGRGSEFELRRQACG</ins><br>RMDKKYSIGLDIGTNSVGWAVITDEYKVPSKKEKVIGNTDRHSIKKNLIGALLF<br>DSGETAEATRIKRTARRRYTRRKNRICYLQEIFSNEMAKVDDSFEHRLEESELV<br>EEDKKHERHPIEGNIVDEVAYHEKYPTIYHIRKKLVDSTDKADLRLIYLALAH<br>MIKERGHFLIEGDLNPDNSDVDKLFIQLVQTYNQLFEENPINASGVDAKAILSAR<br>LSKSRRLENLIAQLPGEKKNGLEGNLIALSLGLTPNEKSNFDLAEDAKLQLSKD<br>TYDDDLDNLLAQIGDQYADLFLAAKNLSDAILLSDILRVNTEITKAPLSASMIKR<br>YDEHHQDLTLLKALVRQQLPEKYKEIFFDQSKNGYAGYIDGGASQEEFYKFIK<br>PILEKMDGTEELLVKLNREDLLRKQRTEDNGSIPHQIHLGELHAILRRQEDFYP<br>FLKDNREKIEKILTFRIPYYVGPLARGNSRFAWMTRKSEETITPWNFEEVVDKG<br>ASAQSFIERMTNEDKNLPNEKVLPKHSLLYEYFTVYNELTKVKYVTEGMRKPA<br>FLSGEQKKAIVDLLEKTNRKVTVKQLKEDYFKKIECEDSVEISGVEDRFNASLG<br>TYHDLLKIIKDKDELDNEENEDILEDIVLTLTLFEDREMIEERLKTYAHLFDDK<br>VMKQLKRRRYTGWGRLSRKLINGIRDKQSGKTILDFLKSDGFANRNFMQLIH<br>DDSLTEKEDIQKAQVSGQGDSLHEHIANLAGSPAIKKGILQTVKVVDELVKVM<br>GRHKPENIVIEMARENQTTQKGQKNSRERMKRIEEGIKELGSQILKEHPVENT<br>QLQNEKLYLYYLQNGRDMYVDQELDINRLSDYDVDHIVPQSFLKDDSIDNKVL<br>TRSDKNRCKSDNVPSEEVVKKMKNYWRQLLNAKLITQRKFDNLTKAERGGLS<br>ELDKAGFIKRQLVETRQITKHVAQILDSRMNTKYDENDKLIREVKVITLKSKLV<br>SDFRKDFQFYKVREINNYHHAHDAYLNAVVGTALIKKYPKLESEFVYGDYKVY<br>DVRKMIAKSEQEIGKATAKYFFYSNIMNFIRTEITLANGEIRKRPLIETNGETGE<br>IVWDKGRDFATVRKVLSMPQVNIVKKTEVQTGGFSKESILPKRNSDKLIARKK<br>DWDPKKYGGFDSPTVAYSVLVVAKVEKGKSKKLKSVKELLGITIMERSSFEKN<br>PIDFLEAKGYKEVKKDLIIKLPKYSLFELENGRKRMLASAGELQKGNELALPSK<br>YVNFLYLASHYEKLKGSPEDNEQKQLFVEQHKHYLDEHEQISEFSKRVILADA<br>NLDKVLSAYNKHRDKPIREQAENIIHLFTLTNLGAPAAFKYFDTTIDRKRYTST<br>KEVLDATLIHQSITGLYETRIDLSQLGGDAAALDLQVKQQIQLRRREVDETADLPA<br>*ELPPLLRRLYASRGVRSAQELERSVKGMLPWQQLSGVEKAVEILYNAFREGTRIIVVGDFD*<br>*ADGATSTALSVLAMRSLGCSNIDYLVPNRFEDGYGLSPEVVDQAHARGAQLIVTVDNGISS*<br>*HAGVEHARSLGIPVIVTDHHLPGDTLPAAEAIINPNLRDCNFPSKSLAGVGVAFYLMLALR*<br>*TFLRDQGWFDERNIAIPNLAELLDLVALGTVADVVPLDANNRILTWQGAISRIRAGKCRPG*<br>*IKALLEVANRDAQKLAASDLGFALGPRLNAAGRLDDMSVGVALLLCDNIGEARVLANELD*<br>*ALNQTRKEIEQGMQIEALTLCEKLERSRDTLPGGLAMYHPEWHQGVVGILASRIKERFHR*<br>*PVIAFAPAGDGTLKGSGRSIQGLHMRDALERLDTLYPGABILKEGGHAMAAGLSLEEDK*<br>*FKLFQQRFGELVTEWLDPSLLQGEVVSDGPLSPAEMTMEVAQLLRDAGPWGQMFPEPL*<br>*FDGHFRLLQQRLVGERHLKVMVEPVGGGPLLDGIAFNVDTALWPDNGVREVQLAYKLD*<br>*INEFRGNRSLQIIIDNIWPILQKRPAATKKAGQAKKKKHHHHHH* | Underlining indicates SSB-Bold indicates SpyCas9-Italics indicates RecJ |
| 27 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCC<ins>ATGGCT</ins><br><ins>AAAAAGAAATGGTTGAATTTGATGAAGCTATCCATGGCGAAGACTTGGCTAA</ins><br><ins>ATTTATTAAAGAAGCATCTGATCATAAACTGAAAATTTCCGGTTATAATGAACT</ins> | Underlining indicates DSB-Bold indicates |

TABLE 7-continued

| SEQ ID NO | Sequence | Description |
|---|---|---|
| | GATTAAAGATATTCGAATTCGTGCTAAAGATGAACTTGGCGTTGATGGTAAGAT GTTTAATCGTCTATTAGCTTTGTATCATAAAGATAACCGTGATGTGTTTGAAGCT GAAACTGAAGAGGTAGTTGAACTTTATGACACAGTTTTCTCTAAAGGATCCGAA TTCGAGCTCCGTCGACAAGCTTGCGGCCGCATGGACAAGAAGTACAGCATCG GCCTGGACATCGGTACCAACAGCGTGGGCTGGGCCGTGATCACCGACGAG TACAAGGTGCCCAGCAAGAAGTTCAAGGTGCTGGGCAACACCGACCGCCA CAGCATCAAGAAGAACCTGATCGGCGCCCTGCTGTTCGACAGCGGCGAGA CCGCCGAGGCCACCCGCCTGAAGCGCACCGCCCGCCGCCGCTACACCCGC CGCAAGAACCGCATCTGCTACCTGCAGGAGATCTTCAGCAACGAGATGGCC AAGGTGGACGACAGCTTCTTCCACCGCCTGGAGGAGAGCTTCCTGGTGGA GGAGGACAAGAAGCACGAGCGCCACCCCATCTTCGGCAACATCGTGGACG AGGTGGCCTACCACGAGAAGTACCCCACCATCTACCACCTGCGCAAGAAGC TGGTGGACAGCACCGACAAGGCCGACCTGCGCCTGATCTACCTGGCCCTG GCCCACATGATCAAGTTCCGCGGCCACTTCCTGATCGAGGGCGACCTGAAC CCCGACAACAGCGACGTGGACAAGCTGTTCATCCAGCTGGTGCAGACCTAC AACCAGCTGTTCGAGGAGAACCCCATCAACGCCAGCGGCGTGGACGCCAA GGCCATCCTGAGCGCCCGCCTGAGCAAGAGCCGCCGCCTGGAGAACCTGA TCGCCCAGCTGCCCGGCGAGAAGAAGAACGGCCTGTTCGGCAACCTGATC GCCCTGAGCCTGGGCCTGACCCCCAACTTCAAGAGCAACTTCGACCTGGCC GAGGACGCCAAGCTGCAGCTGAGCAAGGACACCTACGACGACGACCTGGA CAACCTGCTGGCCCAGATCGGCGACCAGTACGCCGACCTGTTCCTGGCCGC CAAGAACCTGAGCGACGCCATCCTGCTGAGCGACATCCTGCGCGTGAACAC CGAGATCACCAAGGCCCCCCTGAGCGCCAGCATGATCAAGCGCTACGACG AGCACCACCAGGACCTGACCCTGCTGAAGGCCCTGGTGCGCCAGCAGCTG CCCGAGAAGTACAAGGAGATCTTCTTCGACCAGAGCAAGAACGGCTACGCC GGCTACATCGACGGCGGCGCCAGCCAGGAGGAGTTCTACAAGTTCATCAA GCCCATCCTGGAGAAGATGGACGGCACCGAGGAGCTGCTGGTGAAGCTGA ACCGCGAGGACCTGCTGCGCAAGCAGCGCACCTTCGACAACGGCAGCATC CCCCACCAGATCCACCTGGGCGAGCTGCACGCCATCCTGCGCCGCCAGGA GGACTTCTACCCCTTCCTGAAGGACAACCGCGAGAAGATCGAGAAGATCCT GACCTTCCGCATCCCCTACTACGTGGGCCCCCTGGCCCGCGGCAACAGCCG CTTCGCCTGGATGACCCGCAAGAGCGAGGAGACCATCACCCCCTGGAACTT CGAGGAGGTGGTGGACAAGGGCGCCAGCGCCCAGAGCTTCATCGAGCGCA TGACCAACTTCGACAAGAACCTGCCCAACGAGAAGGTGCTGCCCAAGCACA GCCTGCTGTACGAGTACTTCACCGTGTACAACGAGCTGACCAAGGTGAAGT ACGTGACCGAGGGCATGCGCAAGCCCGCCTTCCTGAGCGGCGAGCAGAAG AAGGCCATCGTGGACCTGCTGTTCAAGACCAACCGCAAGGTGACCGTGAA GCAGCTGAAGGAGGACTACTTCAAGAAGATCGAGTGCTTCGACAGCGTGG AGATCAGCGGCGTGGAGGACCGCTTCAACGCCAGCCTGGGCACCTACCAC GACCTGCTGAAGATCATCAAGGACAAGGACTTCCTGGACAACGAGGAGAA CGAGGACATCCTGGAGGACATCGTGCTGACCCTGACCCTGTTCGAGGACC GCGAGATGATCGAGGAGCGCCTGAAGACCTACGCCCACCTGTTCGACGAC AAGGTGATGAAGCAGCTGAAGCGCCGCCGCTACACCGGCTGGGGCCGCCT GAGCCGCAAGCTTATCAACGGCATCCGCGACAAGCAGAGCGGCAAGACCA TCCTGGACTTCCTGAAGAGCGACGGCTTCGCCAACCGCAACTTCATGCAGC TGATCCACGACGACAGCCTGACCTTCAAGGAGGACATCCAGAAGGCCCAG GTGAGCGGCCAGGGCGACAGCCTGCACGAGCACATCGCCAACCTGGCCGG CAGCCCCGCCATCAAGAAGGGCATCCTGCAGACCGTGAAGGTGGTGGACG AGCTGGTGAAGGTGATGGGCCGCCACAAGCCCGAGAACATCGTGATCGAG ATGGCCCGCGAGAACCAGACCACCCAGAAGGGCCAGAAGAACAGCCGCGA GCGCATGAAGCGCATCGAGGAGGGCATCAAGGAGCTGGGCAGCCAGATCC TGAAGGAGCACCCCGTGGAGAACACCCAGCTGCAGAACGAGAAGCTGTAC CTGTACTACCTGCAGAACGGCCGCGACATGTACGTGGACCAGGAGCTGGA CATCAACCGCCTGAGCGACTACGACGTGGACCACATCGTGCCCCAGAGCTT CCTGAAGGACGACAGCATCGACAACAAGGTGCTGACCCGCAGCGACAAGA ACCGCGGCAAGAGCGACAACGTGCCCAGCGAGGAGGTGGTGAAGAAGATG AAGAACTACTGGCGCCAGCTGCTGAACGCCAAGCTGATCACCCAGCGCAA GTTCGACAACCTGACCAAGGCCGAGCGCGGCGGCCTGAGCGAGCTGGACA AGGCCGGCTTCATCAAGCGCCAGCTGGTGGAGACCCGCCAGATCACCAAG CACGTGGCCCAGATCCTGGACAGCCGCATGAACACCAAGTACGACGAGAA CGACAAGCTGATCCGCGAGGTGAAGGTGATCACCCTGAAGAGCAAGCTGG TGAGCGACTTCCGCAAGGACTTCCAGTTCTACAAGGTGCGCGAGATCAACA ACTACCACCACGCCCACGACGCCTACCTGAACGCCGTGGTGGGCACCGCC CTGATCAAGAAGTACCCCAAGCTGGAGAGCGAGTTCGTGTACGGCGACTAC AAGGTGTACGACGTGCGCAAGATGATCGCCAAGAGCGAGCAGGAGATCGG CAAGGCCACCGCCAAGTACTTCTTCTACAGCAACATCATGAACTTCTTCAA GACCGAGATCACCCTGGCCAACGGCGAGATCCGCAAGCGCCCCCTGATCG AGACCAACGGCGAGACCGGCGAGATCGTGTGGGACAAGGGCCGCGACTTC GCCACCGTGCGCAAGGTGCTGAGCATGCCCCAGGTGAACATCGTGAAGAA GACCGAGGTGCAGACCGGCGGCTTCAGCAAGGAGAGCATCCTGCCCAAGC GCAACAGCGACAAGCTGATCGCCCGCAAGAAGGACTGGGACCCCAAGAAG TACGGCGGCTTCGACAGCCCCACCGTGGCCTACAGCGTGCTGGTGGTGGC CAAGGTGGAGAAGGGCAAGAGCAAGAAGCTGAAGAGCGTGAAGGAGCTGC TGGGCATCACCATCATGGAGCGCAGCAGCTTCGAGAAGAACCCCATCGACT TCCTGGAGGCCAAGGGCTACAAGGAGGTGAAGAAGGACCTGATCATCAAG CTGCCCAAGTACAGCCTGTTCGAGCTGGAGAACGGCCGCAAGCGCATGCT | SpyCas9 |

TABLE 7-continued

| SEQ ID NO | Sequence | Description |
|---|---|---|
| | GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>GGCGGCGACGCGGCCGCACTCGACCTCGAGAAAAGGCCGGCGGCCACGAAAA<br>AGGCCGGCCAGGCAAAAAAGAAAAAGCACCACCACCACCACCACTGA | |
| 28 | MGSSHHHHHSSGLVPRGSHMASMTGGQQMGRGS<u>MAKKEMVEFDEATHGEDLA<br>KFIKEASDHKLKISGYNELIKDIRIRAKDELGVDGKMFNRLLALYHKDNRDVFEAET<br>EEVVELYDTVFSKGSEFELRRQACGR</u>**MDKKYSIGLDIGTNSVGWAVITDEYKVPS<br>KKFKVLGNTDRHSIKKNLIGALLFDSGETAEATRLKRTARRRYTRRKNRICYL<br>QEIFSNEMAKVDDSFFHRLEESFLVEEDKKHERHPIFGNIVDEVAYHEKYPTIY<br>HLRKKLVDSTDKADLRLIYLALAHMIKFRGHFLIEGDLNPDNSDVDKLFIQLVQ<br>TYNQLFEENPINASGVDAKAILSARLSKSRRLENLIAQLPGEKKNGLFGNLIALS<br>LGLTPNFKSNFDLAEDAKLQLSKDTYDDDLDNLLAQIGDQYADLFLAAKNLSD<br>AILLSDILRVNTEITKAPLSASMIKRYDEHHQDLTLLKALVRQQLPEKYKEIFFD<br>QSKNGYAGYIDGGASQEEFYKFIKPILEKMDGTEELLVKLNREDLLRKQRTFD<br>NGSIPHQIHLGELHAILRRQEDFYPFLKDNREKIEKILTFRIPYYVGPLARGNSR<br>FAWMTRKSEETITPWNFEEVVDKGASAQSFIERMTNFDKNLPNEKVLPKHSLL<br>YEYFTVYNELTKVKYVTEGMRKPAFLSGEQKKAIVDLLFKTNRKVTVKQLKE<br>DYFKKIECFDSVEISGVEDRFNASLGTYHDLLKIIKDKDFLDNEENEDILEDIVLT<br>LTLFEDREMIEERLKTYAHLFDDKVMKQLKRRRYTGWGRLSRKLINGIRDKQ<br>SGKTILDFLKSDGFANRNFMQLIHDDSLTFKEDIQKAQVSGQGDSLHEHIANLA<br>GSPAIKKGILQTVKVVDELVKVMGRHKPENIVIEMARENQTTQKGQKNSRER<br>MKRIEEGIKELGSQILKEHPVENTQLQNEKLYLYYLQNGRDMYVDQELDINRL<br>SDYDVDHIVPQSFLKDDSIDNKVLTRSDKNRGKSDNVPSEEVVKKMKNYWRQL<br>LNAKLITQRKFDNLTKAERGGLSELDKAGFIKRQLVETRQITKHVAQILDSRM<br>NTKYDENDKLIREVKVITLKSKLVSDFRKDFQFYKVREINNYHHAHDAYLNAV<br>VGTALIKKYPKLESEFVYGDYKVYDVRKMIAKSEQEIGKATAKYFFYSNIMNFF<br>KTEITLANGEEIRKRPLIETNGETGEIVWDKGRDFATVRKVLSMPQVNIVKKTEV<br>QTGGFSKESILPKRNSDKLIARKKDWDPKKYGGFDSPTVAYSVLVVAKVEKGK<br>SKKLKSVKELLGITIMERSSFEKNPIDFLEAKGYKEVKKDLIIKLPKYSLFELEN<br>GRKRMLASAGELQKGNELALPSKYVNFLYLASHYEKLKGSPEDNEQKQLFVE<br>QHKHYLDEHEQISEFSKRVILADANLDKVLSAYNKHRDKPIREQAENIIHLFTL<br>TNLGAPAAFKYFDTTIDRKRYTSTKEVLDATLIHQSITGLYETRIDLSQLGGDA<br>AALDLEKRPAATKKAGQAKKKKHHHHHH | Underlining indicates DSB-Bold indicates SpyCas9 |
| 29 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCC<u>ATGGCT<br>AAAAAAGAAATGGTTGAATTTGATGAAGCTATCCATGGCGAAGACTTGGCTAA<br>ATTTATTAAAGAAGCATCTGATCATAAACTGAAAATTTCCGGTTATAAGAACT<br>GATTAAAGATATTCGAATTCGTGCTAAAGATGAACTTGGCGTTGATGGTAAGAT<br>GTTTAATCGTCTATTAGCTTTGTATCATAAAGATAACCGTGATGTGTTTGAAGCT<br>GAAACTGAAGAGGTAGTTGAACTTTATGACACAGTTTTCTCTAAAGGATCCGAA</u>*TTCGAGCTCCGTCGACAAGCTTGCGGCCGC*ATGGACAAGAAGTACAGCATCG<br>GCCTGGACATCGGTACCAACAGCGTGGGCTGGGCCGTGATCACCGACGAG<br>TACAAGGTGCCCAGCAAGAAGTTCAAGGTGCTGGGCAACACCGACCGCCA<br>CAGCATCAAGAAGAACCTGATCGGCGCCCTGCTGTTCGACAGCGGCGAGA<br>CCGCCGAGGCCACCCGCCTGAAGCGCACCGCCCGCCGCCGCTACACCCGC<br>CGCAAGAACCGCATCTGCTACCTGCAGGAGATCTTCAGCAACGAGATGGCC<br>AAGGTGGACGACAGCTTCTTCCACCGCCTGGAGGAGAGCTTCCTGGTGGA<br>GGAGGACAAGAAGCACGAGCGCCACCCCATCTTCGGCAACATCGTGGACG<br>AGGTGGCCTACCACGAGAAGTACCCCACCATCTACCACCTGCGCAAGAAGC<br>TGGTGGACAGCACCGACAAGGCCGACCTGCGCCTGATCTACCTGGCCCTG<br>GCCCACATGATCAAGTTCCGCGGCCACTTCCTGATCGAGGGCGACCTGAAC<br>CCCGACAACAGCGACGTGGACAAGCTGTTCATCCAGCTGGTGCAGACCTAC<br>AACCAGCTGTTCGAGGAGAACCCCATCAACGCCAGCGGCGTGGACGCCAA<br>GGCCATCCTGAGCGCCCGCCTGAGCAAGAGCCGCCGCCTGGAGAACCTGA<br>TCGCCCAGCTGCCCGGCGAGAAGAAGAACGGCCTGTTCGGCAACCTGATC<br>GCCCTGAGCCTGGGCCTGACCCCCAACTTCAAGAGCAACTTCGACCTGGCC<br>GAGGACGCCAAGCTGCAGCTGAGCAAGGACACCTACGACGACGACCTGGA<br>CAACCTGCTGGCCCAGATCGGCGACCAGTACGCCGACCTGTTCCTGGCCGC<br>CAAGAACCTGAGCGACGCCATCCTGCTGAGCGACATCCTGCGCGTGAACAC<br>CGAGATCACCAAGGCCCCCCTGAGCGCCAGCATGATCAAGCGCTACGACG<br>AGCACCACCAGGACCTGACCCTGCTGAAGGCCCTGGTGCGCCAGCAGCTG<br>CCCGAGAAGTACAAGGAGATCTTCTTCGACCAGAGCAAGAACGGCTACGCC<br>GGCTACATCGACGGCGGCGCCAGCCAGGAGGAGTTCTACAAGTTCATCAA<br>GCCCATCCTGGAGAAGATGGACGGCACCGAGGAGCTGCTGGTGAAGCTGA<br>ACCGCGAGGACCTGCTGCGCAAGCAGCGCACCTTCGACAACGGCAGCATC<br>CCCCACCAGATCCACCTGGGCGAGCTGCACGCCATCCTGCGCCGCCAGGA<br>GGACTTCTACCCCTTCCTGAAGGACAACCGCGAGAAGATCGAGAAGATCCT | Underlining indicates DSB-Bold indicates SpyCas9-Italics indicates RecJ |

TABLE 7-continued

| SEQ ID NO | Sequence | Description |
|---|---|---|
| | GACCTTCCGCATCCCCTACTACGTGGGCCCCCTGGCCCGCGGCAACAGCCG<br>CTTCGCCTGGATGACCCGCAAGAGCGAGGAGACCATCACCCCCTGGAACTT<br>CGAGGAGGTGGTGGACAAGGGCGCCAGCGCCCAGAGCTTCATCGAGCGCA<br>TGACCAACTTCGACAAGAACCTGCCCAACGAGAAGGTGCTGCCCAAGCACA<br>GCCTGCTGTACGAGTACTTCACCGTGTACAACGAGCTGACCAAGGTGAAGT<br>ACGTGACCGAGGGCATGCGCAAGCCCGCCTTCCTGAGCGGCGAGCAGAAG<br>AAGGCCATCGTGGACCTGCTGTTCAAGACCAACCGCAAGGTGACCGTGAA<br>GCAGCTGAAGGAGGACTACTTCAAGAAGATCGAGTGCTTCGACAGCGTGG<br>AGATCAGCGGCGTGGAGGACCGCTTCAACGCCAGCCTGGGCACCTACCAC<br>GACCTGCTGAAGATCATCAAGGACAAGGACTTCCTGGACAACGAGGAGAA<br>CGAGGACATCCTGGAGGACATCGTGCTGACCCTGACCCTGTTCGAGGACC<br>GCGAGATGATCGAGGAGCGCCTGAAGACCTACGCCCACCTGTTCGACGAC<br>AAGGTGATGAAGCAGCTGAAGCGCCGCCGCTACACCGGCTGGGGCCGCCT<br>GAGCCGCAAGCTTATCAACGGCATCCGCGACAAGCAGAGCGGCAAGACCA<br>TCCTGGACTTCCTGAAGAGCGACGGCTTCGCCAACCGCAACTTCATGCAGC<br>TGATCCACGACGACAGCCTGACCTTCAAGGAGGACATCCAGAAGGCCCAG<br>GTGAGCGGCCAGGGCGACAGCCTGCACGAGCACATCGCCAACCTGGCCGG<br>CAGCCCCGCCATCAAGAAGGGCATCCTGCAGACCGTGAAGGTGGTGGACG<br>AGCTGGTGAAGGTGATGGGCCGCCACAAGCCCGAGAACATCGTGATCGAG<br>ATGGCCCGCGAGAACCAGACCACCCAGAAGGGCCAGAAGAACAGCCGCGA<br>GCGCATGAAGCGCATCGAGGAGGGCATCAAGGAGCTGGGCAGCCAGATCC<br>TGAAGGAGCACCCCGTGGAGAACACCCAGCTGCAGAACGAGAAGCTGTAC<br>CTGTACTACCTGCAGAACGGCCGCGACATGTACGTGGACCAGGAGCTGGA<br>CATCAACCGCCTGAGCGACTACGACGTGGACCACATCGTGCCCCAGAGCTT<br>CCTGAAGGACGACAGCATCGACAACAAGGTGCTGACCCGCAGCGACAAGA<br>ACCGCGGCAAGAGCGACAACGTGCCCAGCGAGGAGGTGGTGAAGAAGATG<br>AAGAACTACTGGCGCCAGCTGCTGAACGCCAAGCTGATCACCCAGCGCAA<br>GTTCGACAACCTGACCAAGGCCGAGCGCGGCGGCCTGAGCGAGCTGGACA<br>AGGCCGGCTTCATCAAGCGCCAGCTGGTGGAGACCCGCCAGATCACCAAG<br>CACGTGGCCCAGATCCTGGACAGCCGCATGAACACCAAGTACGACGAGAA<br>CGACAAGCTGATCCGCGAGGTGAAGGTGATCACCCTGAAGAGCAAGCTGG<br>TGAGCGACTTCCGCAAGGACTTCCAGTTCTACAAGGTGCGCGAGATCAACA<br>ACTACCACCACGCCCACGACGCCTACCTGAACGCCGTGGTGGGCACCGCC<br>CTGATCAAGAAGTACCCCAAGCTGGAGAGCGAGTTCGTGTACGGCGACTAC<br>AAGGTGTACGACGTGCGCAAGATGATCGCCAAGAGCGAGCAGGAGATCGG<br>CAAGGCCACCGCCAAGTACTTCTTCTACAGCAACATCATGAACTTCTTCAA<br>GACCGAGATCACCCTGGCCAACGGCGAGATCCGCAAGCGCCCCCTGATCG<br>AGACCAACGGCGAGACCGGCGAGATCGTGTGGGACAAGGGCCGCGACTTC<br>GCCACCGTGCGCAAGGTGCTGAGCATGCCCCAGGTGAACATCGTGAAGAA<br>GACCGAGGTGCAGACCGGCGGCTTCAGCAAGGAGAGCATCCTGCCCAAGC<br>GCAACAGCGACAAGCTGATCGCCCGCAAGAAGGACTGGGACCCCAAGAAG<br>TACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGC<br>TGGGCATCACCATCATGGAGCGCAGCAGCTTCGAGAAGAACCCCATCGACT<br>TCCTGGAGGCCAAGGGCTACAAGGAGGTGAAGAAGGACCTGATCATCAAG<br>CTGCCCAAGTACAGCCTGTTCGAGCTGGAGAACGGCCGCAAGCGCATGCT<br>GGCCAGCGCCGGCGAGCTGCAGAAGGGCAACGAGCTGGCCCTGCCCAGCA<br>AGTACGTGAACTTCCTGTACCTGGCCAGCCACTACGAGAAGCTGAAGGGCA<br>GCCCCGAGGACAACGAGCAGAAGCAGCTGTTCGTGGAGCAGCACAAGCAC<br>TACCTGGACGAGATCATCGAGCAGATCAGCGAGTTCAGCAAGCGCGTGATC<br>CTGGCCGACGCCAACCTGGACAAGGTGCTGAGCGCCTACAACAAGCACCG<br>CGACAAGCCCATCCGCGAGCAGGCCGAGAACATCATCCACCTGTTCACCCT<br>GACCAACCTGGGCGCCCCCGCCGCCTTCAAGTACTTCGACACCACCATCGA<br>CCGCAAGCGCTACACCAGCACCAAGGAGGTGCTGGACGCCACCCTGATCC<br>ACCAGAGCATCACCGGTCTGTACGAGACCCGCATCGACCTGAGCCAGCTG<br>*GGCGGCGACGCGGCCGCACTCGACCTGCAGGTGAAACAACAGATACAACTTCGTC*<br>*GCCGTGAAGTCGATGAAACGGCAGACTTGCCCGCTGAATTGCCTCCCTTGCTGCGCC*<br>*GTTTATACGCCAGCCGGGGAGTACGCAGTGCGCAAGAACTGGAACGCAGTGTTAAAG*<br>*GTATGCTGCCCTGGCAGCAACTGAGCGGCGTCGAAAAGGCCGTTGAGATCCTTTACA*<br>*ACGCTTTTCGCAAGGAACGCGGATTATTGTGGTCGGTGATTTCGACGCCGACGGCG*<br>*CGACCAGCACGGCTCTAAGCGTGCTGGCGATGCGCTCGCTTGGTTGCAGCAATATCG*<br>*ACTACCTGGTACCAAACCGTTTCGAAGACGGTTACGGCTTAAGCCCGGAAGTGGTCG*<br>*ATCAGGCCCATGCCCGTGGCGCGCAGTTAATTGTCACGGTGGATAACGGTATTTCCT*<br>*CCCATGCGGGGGTTGAGCACGCTCGCTCGTTGGGCATCCCGGTTATTGTTACCGATC*<br>*ACCATTTGCCAGGCGACACATTACCCGCAGCGGAAGCGATCATTAACCCTAACTTGC*<br>*GCGACTGTAATTTCCCGTCGAAATCACTGGCAGGCGTGGGTGTGGCGTTTTATCTGAT*<br>*GCTGGCGCTGCGCACCTTTTTGCGCGATCAGGGCTGGTTTGATGAGCGTAACATCGC*<br>*AATTCCTAACCTGGCAGAACTGCTGGATCTGGTCGCGCTGGGGACAGTGGCGGACG*<br>*TCGTGCCGCTGGACGCTAATAATCGCATTCTGACCTGGCAGGGGATGAGTCGCATCC*<br>*GAGCCGGAAAGTGCCGTCCGGGGATTAAAGCGCTGCTTGAAGTGGCAAACCGTGAT*<br>*GCACAAAAACTCGCCGCCAGCGATTTAGGTTTTGCGCTGGGGCCACGTCTCAATGCT*<br>*GCCGGACGACTGGACGATATGTCCGTCGGTGTGGCGCTGTTGTTGTGCGACAACATC*<br>*GGCAAGCGCGCGTGCTGGCAAATGAACTCGATGCGCTAAACCAGACGCGAAAAGA*<br>*GATCGAACAAGGAATGCAAATTGAAGCCCTGACCCTGTGCGAGAAACTGGAGCGCAG*<br>*CCGTGACACGCTACCCGGCGGGCTGGCAATGTATCACCCCGAATGGCATCAGGGCG*<br>*TTGTCGGTATTCTGGCTTCGCGCATCAAAGAGCGTTTTCACCGTCCGGTTATCGCGTT* | |

TABLE 7-continued

| SEQ ID NO | Sequence | Description |
|---|---|---|
| | TGCGCCAGCAGGTGACGGTACGCTGAAAGGTTCCGGTCGCTCCATTCAGGGGCTGC<br>ATATGCGTGATGCGCTGGAGCGATTAGACACACTCTACCCTGGCATGATGCTGAAGTT<br>TGGCGGTCATGCGATGGCGGCGGGTTTGTCGCTGGAAGAGGATAAATTCAAACTCTT<br>TCAACAACGGTTTGGCGAACTGGTTACTGAGTGGCTGGACCCTTCGCTATTGCAAGG<br>CGAAGTGGTATCAGACGGTCCGTTAAGCCCGGCCGAAATGACCATGGAAGTGGCGC<br>AGCTGCTGCGCGATGCTGGCCCGTGGGGGCAGATGTTCCCGGAGCCGCTGTTTGAC<br>GGTCATTTCCGTCTGCTGCAACAGCGGCTGGTGGGCGAACGTCATTTGAAGGTGATG<br>GTCGAACCGGTCGGCGGCGGTCCACTGCTGGATGGTATTGCTTTTAATGTCGATACC<br>GCCCTCTGGCCGGATAACGGCGTGCGCGAAGTGCAACTGGCTTATAAGCTCGATATC<br>AACGAGTTTCGCGGCAACCGCAGCCTGCAAATTATCATCGACAATATCTGGCCAATTC<br>TGCAGAAAAGGCCGGCGGCCACGAAAAAGGCCGGCCAGGCAAAAAAGAAAAA<br>GCACCACCACCACCACCACTGA | |
| 30 | MGSSHHHHHHSSGLVPRGSHMASMTGGQQMGRGS<u>MAKKEMVEFDEATHGEDLA</u><br><u>KFIKEASDHKLKISGYNELIKDIRIRAKDELGVDKATFNRLLALYHKDNRDVFEAET</u><br><u>EEVVELYDTVFSKGSEFELRRQACGR</u>MDKKYSIGLDIGTNSVGWAVITDEYKVPS<br>KKFKVLGNTDRHSIKKNLIGALLFDSGETAEATRIKRTARRRYTRRKNRICYL<br>QEIFSNEMAKVDDSFEHRLEESELVEEDKKHERHPIEGNIVDEVAYHEKYPTIY<br>HLRKKLVDSTDKADLRLIYLALAHMIKFRGHFLIEGDLNPDNSDVDKLFIQLVQ<br>TYNQLFEENPINASGVDAKAILSARLSKSRRLENLIAQLPGEKKNGLFGNLIALS<br>*LGLTPNEKSNFDLAEDAKLQLSKDTYDDDLDNLLAQIGDQYADLFLAAKNLSD*<br>*AILLSDILRVNTEITKAPLSASMIKRYDEHHQDLTLLKALVRQQLPEKYKEIFFD*<br>*QSKNGYAGYIDGGASQEEFYKFIKPILEKMDGTEELLVKLNREDLLRKQRTED*<br>*NGSIPHQIHLGELHAILRRQEDFYPFLKDNREKIEKILTFRIPYYVGPLARGNSR*<br>*FAWMTRKSEETITPWNFEEVVDKGASAQSFIERMTNEDKNLPNEKVLPKHSLL*<br>*YEYFTVYNELTKVKYVTEGMRKPAFLSGEQKKAIVDLLFKTNRKVTVKQLKE*<br>*DYFKKIECFDSVEISGVEDRFNASLGTYHDLLKIIKDKDFLDNEENEDILEDIVLT*<br>*LTLFEDREMIEERLKTYAHLFDDKVMKQLKRRRYTGWGRLSRKLINGIRDKQ*<br>*SGKTILDFLKSDGFANRNFMQLIHDDSLTFKEDIQKAQVSGQGDSLHEHIANLA*<br>*GSPAIKKGILQTVKVVDELVKVMGRHKPENIVIEMARENQTTQKGQKNSRER*<br>*MKRIEEGIKELGSQILKEHPVENTQLQNEKLYLYYLQNGRDMYVDQELDINRL*<br>*SDYDVDHIVPQSFLKDDSIDNKVLTRSDKNRGKSDNVPSEEVVKKMKNYWRQL*<br>*LNAKLITQRKFDNLTKAERGGLSELDKAGFIKRQLVETRQITKIIVAQILDSRM*<br>*NTKYDENDKLIREVKVITLKSKLVSDFRKDFQFYKVREINNYHHAHDAYLNAV*<br>*VGTALIKKYPKLESEFVYGDYKVYDVRKMIAKSEQEIGKATAKYFFYSNIMNFF*<br>*KTEITLANGEIRKRPLIETNGETGEIVWDKGRDFATVRKVLSMPQVNIVKKTEV*<br>*QTGGFSKESILPKRNSDKLIARKKDWDPKKYGGFDSPTVAYSVLVVAKVEKGK*<br>*SKKLKSVKELLGITIMERSSFEKNPIDFLEAKGYKEVKKDLIIKLPKYSLFELEN*<br>*GRKRMLASAGELQKGNELALPSKYVNFLYLASHYEKLKGSPEDNEQKQLFVE*<br>*QHKHYLDEHEQISEFSKRVILADANLDKVLSAYNKHRDKPIREQAENIIHLFTL*<br>*TNLGAPAAFKYFDTTIDRKRYTSTKEVLDATLIHQSITGLYETRIDLSQLGGDA*<br>*AALDLQVKQQIQLRRREVDETADLPAELPPLLRRLYASRGVRSAQELERSVKGMLPWQQ*<br>*LSGVEKAVEILYNAFREGTRIIVVGDFDADGATSTALSVLAMRSLGCSNIDYLVPNRFEDG*<br>*YGLSPEVVDQAHARGAQLIVTVDNGISSHAGVEHARSLGIPVIVTDHHLPGDTLPAAEAII*<br>*NPNLRDCNFPSKSLAGVGVAFYLMLALRTFLRDQGWFDERNIAIPNLAELLDLVALGTVA*<br>*DVVPLDANNRILTWQGMSRIRAGKCRPGIKALLEVANRDAQKLAASDLGFALGPRLNAA*<br>*GRLDDMSVGVALLLCDNIGEARVLANELDALNQTRKEIEQGMQIEALTLCEKLERSRDTL*<br>*PGGGLAMYHPEWHQGVVGILASRIKERFHRPVIAFAPAGDGTLKGSGRSIQGLHMRDALE*<br>*RLDTLYPGMMLKFGGHAMAAGLSLEEDKFKLFQQRFGELVTEWLDPSLLQGEVVSDGP*<br>*LSPAEMTMEVAQLLRDAGPWGQMFPEPLFDGHFRLLQQRLVGERHLKVMVEPVGGGP*<br>*LLDGIAFNVDTALWPDNGVREVQLAYKLDINEFRGNRSLQIIIDNIWPILQKRPAATKKA*<br>*GQAKKKKHHHHHH* | Underlining indicates DSB-Bold indicates SpyCas9-Italics indicates RecJ |
| 31 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCCGAATTC<br>GAGCTCCGTCGACAAGCTTGCGGCCGCATGTCAATTTATCAAGAATTTGTTAA<br>TAAATATAGTTTAAGTAAAACTCTAAGATTTGAGTTAATCCCACAGGGTAAA<br>ACACTTGAAAACATAAAAGCAAGAGGTTTGATTTTAGATGATGAGAAAAGA<br>GCTAAAGACTACAAAAAGGCTAAACAAATAATTGATAAATATCATCAGTTTTT<br>TTATAGAGGAGATATTAAGTTCGGTTTGTATTAGCGAAGATTTATTACAAAA<br>CTATTCTGATGTTTATTTTAAACTTAAAAAGAGTGATGATGATAATCTACAA<br>AAAGATTTTAAAAGTGCAAAAGATACGATAAAGAAACAAATATCTGAATAT<br>ATAAAGGACTCAGAGAAATTTAAGAATTTGTTTAATCAAAACCTTATCGATG<br>CTAAAAAAGGGCAAGAGTCAGATTTAATTCTATGGCTAAAGCAATCTAAGG<br>ATAATGGTATAGAACTATTTAAAGCCAATAGTGATATCACAGATATAGATG<br>AGGCGTTAGAAATAATCAAATCTTTTAAAGGTTGGACAACTTATTTTAAGG<br>GTTTTCATGAAAATAGAAAAAATGTTTATAGTAGCAATGATATTCCTACATC<br>TATTATTTATAGGATAGTAGATGATAATTTGCCTAAATTTCTAGAAAATAAA<br>GCTAAGTATGAGAGTTTAAAAGACAAAGCTCCAGAAGCTATAAACTATGAA<br>CAAATTAAAAAAGATTTGGCAGAAGAGCTAACCTTTGATATTGACTACAAA<br>ACATCTGAAGTTAATCAAAGAGTTTTTCACTTGATGAAGTTTTTGAGATAG<br>CAAACTTTAATAATTATCTAAATCAAAGTGGTATTACTAAATTTAATACTAT<br>TATTGGTGGTAAATTTGTAAATGGTGAAATACAAAGAGAAAAGGTATAAA<br>TGAATATACAAATCTATACTCACAGCAAATAAATGATAAAACACTCAAAAAA<br>TATAAAATGAGTGTTTTATTTAAGCAAATTTTAAGTGATACAGAATCTAAAT<br>CTTTTTGTAATTGATAAGTTAGAAGATGATAGTGATGTAGTTACAACGATGC | Bold indicates FnCpf1 |

TABLE 7-continued

| SEQ ID NO | Sequence | Description |
|---|---|---|
| | AAAGTTTTTATGAGCAAATAGCAGCTTTTAAAACAGTAGAAGAAAAATCTA<br>TTAAAGAAACACTATCTTTATTATTTGATGATTTAAAAGCTCAAAAACTTGA<br>TTTGAGTAAAATTTATTTTAAAAATGATAAATCTCTTACTGATCTATCACAA<br>CAAGTTTTTGATGATTATAGTGTTATTGGTACAGCGGTACTAGAATATATAA<br>CTCAACAAATAGCACCTAAAAATCTTGATAACCCTAGTAAGAAAGAGCAAG<br>AATTAATAGCCAAAAAAACTGAAAAAGCAAATACTTATCTCTAGAAACTAT<br>AAAGCTTGCCTTAGAAGAATTTAATAAGCATAGAGATATAGATAAACAGTG<br>TAGGTTTGAAGAAATACTTGCAAACTTTGCGGCTATTCCGATGATATTTGAT<br>GAAATAGCTCAAAACAAAGACAATTTGGCACAGATATCTATCAAATATCAA<br>AATCAAGGTAAAAAAGACCTACTTCAAGCTAGTGCGGAAGATGATGTTAAA<br>GCTATCAAGGATCTTTTAGATCAAACTAATAATCTCTTACATAAACTAAAAA<br>TATTTCATATTAGTCAGTCAGAAGATAAGGCAAATATTTTAGACAAGGATG<br>AGCATTTTTATCTAGTATTTGAGGAGTGCTACTTTGAGCTAGCGAATATAGT<br>GCCTCTTTATAACAAATTAGAAACTATATAACTCAAAAGCCATATAGTGAT<br>GAGAAATTTAAGCTCAATTTTGAGAACTCGACTTTGGCTAATGGTTGGGAT<br>AAAAATAAAGAGCCTGACAATACGGCAATTTTATTTATCAAAGATGATAAAT<br>ATTATCTGGGTGTGATGAATAAGAAAAATAACAAAATATTTGATGATAAAG<br>CTATCAAAGAAAATAAAGGCGAGGGTTATAAAAAAATTGTTTATAAACTTTT<br>ACCTGGCGCAAATAAAATGTTACCTAAGGTTTTCTTTTCTGCTAAATCTATA<br>AAATTTTATAATCCTAGTGAAGATATACTTAGAATAAGAAATCATTCCACAC<br>ATACAAAAAATGGTAGTCCTCAAAAAGGATATGAAAAATTTGAGTTTAATA<br>TTGAAGATTGCCGAAAATTTATAGATTTTTATAAACAGTCTATAAGTAAGCA<br>TCCGGAGTGGAAAGATTTTGGATTTAGATTTTCTGATACTCAAAGATATAAT<br>TCTATAGATGAATTTTATAGAGAAGTTGAAAATCAAGGCTACAAACTAACTT<br>TTGAAAATATATCAGAGAGCTATATTGATAGCGTAGTTAATCAGGGTAAAT<br>TGTACCTATTCCAAATCTATAATAAAGATTTTTCAGCTTATAGCAAAGGGCG<br>ACCAAATCTACATACTTTATATTGGAAAGCGCTGTTTGATGAGAGAAATCTT<br>CAAGATGTGGTTTATAAGCTAAATGGTGAGGCAGAGCTTTTTTATCGTAAA<br>CAATCAATACCTAAAAAAAATCACTCACCCAGCTAAAGAGGCAATAGCTAAT<br>AAAAACAAAGATAATCCTAAAAAAGAGAGTGTTTTTGAATATGATTTAATCA<br>AGATAAACGCTTTACTGAAGATAAGTTTTTCTTTCACTGTCCTATTACAAT<br>CAATTTTAAATCTAGTGGAGCTAATAAGTTTAATGATGAAATCAATTTATTG<br>CTAAAAGAAAAGCAAATGATGTTCATATATTAAGTATAGATAGAGGTGAA<br>AGACATTTAGCTTACTATACTTTGGTAGATGGTAAAGGCAATATCATCAAA<br>CAAGATACTTTCAACATCATTGGTAATGATAGAATGAAAACAAACTACCAT<br>GATAAGCTTGCTGCAATAGAGAAAGATAGGGATTCAGCTAGGAAAGACTGG<br>AAAAAGATAAATAACATCAAAGAGATGAAAGAGGGCTATCTATCTCAGGTA<br>GTTCATGAAATAGCTAAGCTAGTTATAGAGTATAATGCTATTGTGGTTTTTG<br>AGGATTTAAATTTTGGATTTAAAAGAGGGCGTTTCAAGGTAGAGAAGCAGG<br>TCTATCAAAAGTTAGAAAAAATGCTAATTGAGAAACTAAACTATCTAGTTTT<br>CAAAGATAATGAGTTTGATAAAACTGGGGGAGTGCTTAGAGCTTATCAGCT<br>AACAGCACCTTTTGAGACTTTTAAAAAGATGGGTAAACAAACAGGTATTAT<br>CTACTATGTACCAGCTGGTTTTACTTCAAAAATTTGTCCTGTAACTGGTTTT<br>GTAAATCAGTTATATCCTAAGTATGAAAGTGTCAGCAAATCTCAAGAGTTC<br>TTTAGTAAGTTTGACAAGATTTGTTATAACCTTGATAAGGGCTATTTTGAGT<br>TTAGTTTTGATTATAAAAACTTTGGTGACAAGGCTGCCAAAGGCAAGTGGA<br>CTATAGCTAGCTTTGGGAGTAGATTGATTAACTTTAGAAATTCAGATAAAA<br>ATCATAATTGGGATACTCGAGAAGTTTATCCAACTAAAGAGTTGGAGAAAT<br>TGCTAAAAGATTATTCTATCGAATATGGGCATGGCGAATGTATCAAAGCAG<br>CTATTTGCGGTGAGAGCGACAAAAAGTTTTTTGCTAAGCTAACTAGTGTCC<br>TAAATACTATCTTACAAATGCGTAACTCAAAAACAGGTACTGAGTTAGATTA<br>TCTAATTTCACCAGTAGCAGATGTAAATGGCAATTTCTTTGATTCGCGACA<br>GGCGCCAAAAAATATGCCTCAAGATGCTGATGCCAATGGTGCTTATCATAT<br>TGGGCTAAAAGGTCTGATGCTACTAGGTAGGATCAAAAATAATCAAGAGGG<br>CAAAAAACTCAATTTGGTTATCAAAAATGAAGAGTATTTTGAGTTCGTGCA<br>GAATAGGAATAACCAAGCGGCCGCACTCGAGAAAAGGCCGGCGGCCACGAA<br>AAGGCCGGCCAGGCAAAAAAGAAAAAGTCGACACCACCACCACCACTGAG<br>ATCCGGCTGCTAA | |
| 32 | MGSSHHHHHHSSGLVPRGSHMASMTGGQQMGRGSEFELRRQACGR**MSIYQEFVN<br>KYSLSKTERFELIPQGKTLENIKARGLILDDEKRAKDYKKAKQIIDKYHQFFIEE<br>ILSSVCISEDLLQNYSDVYFKLKKSDDDNLQKDEKSAKDTIKKQISEYIKDSEKE<br>KNLFNQNLIDAKKGQESDLIEWLKQSKDNGIELFKANSDITDIDEALEIIKSFKG<br>WTTYFKGEHENRKNVYSSNDIPTSIIYRIVDDNLPKFLENKAKYESLKDKAPEAI<br>NYEQIKKDLAEELTEDIDYKTSEVNQRVESLDEVFEIANFNNYLNQSGITKENTII<br>GGKEVNGENTKRKGINEYINLYSQQINDKTLKKYKMSVLEKQILSDTESKSFVI<br>DKLEDDSDVVTTMQSFYEQIAAFKTVEEKSIKETLSELFDDLKAQKLDLSKIYF<br>KNDKSLTDESQQVFDDYSVIGTAVLEYITQQIAPKNEDNPSKKEQELIAKKTEK<br>AKYLSLETIKLALEEFNKHRDIDKQCRFEEILANFAAIPMIFDEIAQNKDNLAQI<br>SIKYQNQGKKDLLQASAEDDVKAIKDLLDQTNNLLHKLKIFHISQSEDKANILD<br>KDEHFYLVFEECYFELANIVPLYNKIRNYITQKPYSDEKFKLNFENSTLANGWD<br>KNKEPDNTAILFIKDDKYYLGVMNKKNNKIFDDKAIKENKGEGYKKIVYKLLP<br>GANKMLPKVFFSAKSIKFYNPSEDILRIRNHSTHTKNGSPQKGYEKFEFNIEDC<br>RKFIDFYKQSISKHPEWKDFGFRFSDTQRYNSIDEFYREVENQGYKLTFENISES<br>YIDSVVNQGKLYLFQIYNKDFSAYSKGRPNLHTLYWKALFDERNLQDVVYKLN<br>GEAELFYRKQSIPKKITHPAKEAIANKNKDNPKKESVFEYDLIKDKRFTEDKFF | Bold indicates FnCpf1 |

TABLE 7-continued

| SEQ ID NO | Sequence | Description |
|---|---|---|
| | FHCPITINFKSSGANKFNDEINLLLKEKANDVHILSIDRGERHLAYYTLVDGKG NIIKQDTFNIIGNDRMKTNYHDKLAAIEKDRDSARKDWKKINNIKEMKEGYLS QVVHEIAKLVIEYNAIVVFEDLNFGFKRGRFKVEKQVYQKLEKMLIEKLNYLV FKDNEFDKTGGVLRAYQLTAPFETFKKMGKQTGIIIYYVPAGFTSKICPVTGFV NQLYPKYESVSKSQEFFSKFDKICYNLDKGYFEFSFDYKNFGDKAAKGKWTIA SFGSRLINFRNSDKNHNWDTREVYPTKELEKLLKDYSIEYGHGECIKAAICGES DKKFFAKLTSVLNTILQMRNSKTGTELDYLISPVADVNGNFFDSRQAPKNMPQ DADANGAYHIGLKGLMLLGRIKNNQEGKKLNLVIKNEEYFEFVQNRNNQAAA LEKRPAATKKAGQAKKKKSTPPPPPLRSGC | |
| 33 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGCATGTCAATTTATCAAGAATTTGTTAA TAAATATAGTTTAAGTAAAACTCTAAGATTTGAGTTAATCCCACAGGGTAAA ACACTTGAAAACATAAAAGCAAGAGGTTTGATTTTAGATGATGAGAAAGA GCTAAAGACTACAAAAAGGCTAAACAAATAATTGATAAATATCATCAGTTTT TTATAGAGGAGATATTAAGTTCGGTTTGTATTAGCGAAGTATTATTACAAAA CTATTCTGATGTTTATTTTAAACTTAAAAAGAGTGATGATGATAATCTACAA AAAGATTTTAAAAGTGCAAAAGATACGATAAAGAAACAAATATCTGAATAT ATAAAGGACTCAGAGAAATTTAAGAATTTGTTTAATCAAAACCTTATCGATG CTAAAAAAGGGCAAGAGTCAGATTTAATTCTATGGCTAAAGCAATCTAAGG ATAATGGTATAGAACTATTTAAAGCCAATAGTGATATCACAGATATAGATG AGGCGTTAGAAATAATCAAATCTTTTAAAGGTTGGACAACTTATTTTAAGG GTTTTCATGAAAATAGAAAAAATGTTTATAGTAGCAATGATATTCCTACATC TATTATTTATAGGATAGTAGATGATAATTTGCCTAAATTTCTAGAAAATAAA GCTAAGTATGAGAGTTTAAAAGACAAAGCTCCAGAAGCTATAAACTATGAA CAAATTAAAAAAGATTTGGCAGAAGAGCTAACCTTTGATATTGACTACAAA ACATCTGAAGTTAATCAAAGAGTTTTTTCACTTGATGAAGTTTTTGAGATAG CAAACTTTAATAATTATCTAAATCAAAGTGGTATTACTAAATTTAATACTAT TATTGGTGGTAAATTTGTAAATGGTGAAAATACAAAGAGAAAAGGTATAAA TGAATATATAAATCTATACTCACAGCAAATAAATGATAAAACACTCAAAAAA TATAAAATGAGTGTTTTATTTAAGCAAATTTTAAGTGATACAGAATCTAAAT CTTTTGTAATTGATAAGTTAGAAGATGATAGTGATGATGTAGTTACAACGATGC AAAGTTTTTATGAGCAAATAGCAGCTTTTAAAACAGTAGAAGAAAAATCTA TTAAAGAAACACTATCTTTATTATTTGATGATTTAAAAGCTCAAAAACTTGA TTTGAGTAAAATTTATTTTAAAAATGATAAATCTCTTACTGATCTATCACAA CAAGTTTTTGATGATTATAGTGTTATTGGTACAGCGGTACTAGAATATATAA CTCAACAAATAGCACCTAAAAAATCTTGATAACCCTAGTAAGAAAGAGCAAG AATTAATAGCCAAAAAAACTGAAAAAGCAAATACTTATCTCTAGAAACTAT AAAGCTTGCCTTAGAAGAATTTAATAAGCATAGAGATATAGATAAACAGTG TAGGTTTGAAGAAATACTTGCAAACTTTGCGGCTATTCCGATGATATTTGAT GAAATAGCTCAAAACAAAGACAATTTGGCACAGATATCTATCAAATATCAA AATCAAGGTAAAAAAGACCTACTTCAAGCTAGTGCGGAAGATGATGTTAAA GCTATCAAGGATCTTTTAGATCAAACTAATAATCTCTTACATAAACTAAAAA TATTTCATATTAGTCAGTCAGAAGATAAGGCAAATATTTTAGACAAGGATG AGCATTTTTATCTAGTATTTGAGGAGTGCTACTTTGAGCTAGCGAATAGT GCCTCTTTATAACAAATTAGAAACTATATAACTCAAAAGCCATATAGTGAT GAGAAATTTAAGCTCAATTTTGAGAACTCGACTTTGGCTAATGGTTGGGAT AAAAATAAAGAGCCTGACAATACGGCAATTTTATTTATCAAAGATGATAAAT ATTATCTGGGTGTGATGAATAAGAAAAATAACAAAATATTTGATGATAAAG CTATCAAAGAAATAAAGGCGAGGTTATAAAAAAATTGTTTATAAACTTTT ACCTGGCGCAAATAAATGTTACCTAAGGTTTTCTTTTCTGCTAAATCTATA AAATTTTATAATCCTAGTGAAGATATACTTAGAATAAGAAATCATTCCACAC ATACAAAAAATGGTAGTCCTCAAAAAGGATATGAAAAATTTGAGTTTAATA TTGAAGATTGCCGAAAATTTATAGATTTTTATAAACAGTCTATAAGTAAGCA TCCGGAGTGGAAAGATTTTGGATTTAGATTTTCTGATACTCAAAGATATAAT TCTATAGATGAATTTTATAGAGAAGTTGAAAATCAAGGCTACAAACTAACTT TTGAAAATATATCAGAGAGCTATATTGATAGCGTAGTTAATCAGGGTAAAT TGTACCTATTCCAAATCTATAATAAAGATTTTTCAGCTTATAGCAAAGGGCG ACCAAATCTACATACTTTATATTGGAAAGCGCTGTTTGATGAGAGAAATCTT CAAGATGTGGTTTATAAGCTAAATGGTGAGGCAGAGCTTTTTTATCGTAAA CAATCAATACCTAAAAAAATCACTCACCCAGCTAAAGAGGCAATAGCTAAT AAAAACAAGATAATCCTAAAAAAGAGAGTGTTTTGAATATGATTTAATCA AGATAAACGCTTTACTGAAGTAAGTTTTTCTTTCACTGTCCTATTACAAT CAATTTTAAATCTAGTGGAGCTAATAAGTTTAATGATGAAATCAATTTATTG CTAAAAGAAAAAGCAAATGATGTTCATATATTAAGTATAGATAGAGGTGAA AGATATTAGCTTACTACTTTGGTAGATGGTAAAGGCAATATCATCAAA CAAGATACTTTCAACATCATTGGTAATGATAGAATGAAAACAAACTACCAT GATAAGCTTGCTGCAATAGAAAAGATAGGGATTCAGCTAGGAAAGACTGG AAAAAGATAAATAACATCAAAGAGATGAAAGAGGGCTATCTATCTCAGGTA GTTCATGAAATAGCTAAGCTAGTTATAGAGTATAATGCTATTGTGGTTTTG AGGATTTAAATTTTGGATTTAAAAGAGGGCGTTTCAAGGTAGAGAAGCAGG TCTATCAAAGTTAGAAAAAATGCTAATTGAGAAACTAAACTATCTAGTTTT CAAAGATAATGAGTTTGATAAAACTGGGGGAGTGCTTAGAGCTTATCAGCT AACAGCACCTTTTGAGACTTTTAAAAAGATGGGTAAACAAACAGGTATTAT CTACTATGTACCAGCTGGTTTTACTTCAAAAATTTGTCCTGTAACTGGTTTT | Bold indicates FnCpf1- Underlining indicates RecJ |

TABLE 7-continued

| SEQ ID NO | Sequence | Description |
|---|---|---|
| | GTAAATCAGTTATATCCTAAGTATGAAAGTGTCAGCAAATCTCAAGAGTTC<br>TTTAGTAAGTTTGACAAGATTTGTTATAACCTTGATAAGGGCTATTTTGAGT<br>TTAGTTTTGATTATAAAAACTTTGGTGACAAGGCTGCCAAAGGCAAGTGGA<br>CTATAGCTAGCTTTGGGAGTAGATTGATTAACTTTAGAAATTCAGATAAAA<br>ATCATAATTGGGATACTCGAGAAGTTTATCCAACTAAAGAGTTGGAGAAAT<br>TGCTAAAAGATTATTCTATCGAATATGGGCATGGCGAATGTATCAAAGCAG<br>CTATTTGCGGTGAGAGCGACAAAAAGTTTTTTGCTAAGCTAACTAGTGTCC<br>TAAAATACTATCTTACAAATGCGTAACTCAAAAACAGGTACTGAGTTAGATTA<br>TCTAATTTCACCAGTAGCAGATGTAAATGGCAATTTCTTTGATTCGCGACA<br>GGCGCCAAAAAATATGCCTCAAGATGCTGATGCCAATGGTGCTTATCATAT<br>TGGGCTAAAAGGTCTGATGCTACTAGGTAGGATCAAAAATAATCAAGAGGG<br>CAAAAAACTCAATTTGGTTATCAAAAATGAAGAGTATTTTGAGTTCGTGCA<br>GAATAGGAATAACCAAGCGGCCGCACTCGACCTGCAGGTGAAACAACAGATA<br><u>CAACTTCGTCGCCGTGAAGTCGATGAAACGGCAGACTTGCCCGCTGAATTGCCT<br>CCCTTGCTGCGCCGTTTATACGCCAGCCGGGGCGTGCGCAGTGCGCAAGAACTG<br>GAACGCAGTGTTAAAGGTATGTTGCCCTGGCAGCAACTGAGCGGCGTCGAAAA<br>GGCCGTTGAGATCCTTTACGCTTTTCGCGAAGGAACGCGGATTATTGTGGT<br>CGGCGATTTTGACGCCGACGGCGCGACCAGCACGGCTCTAAGCGTGCTGGCGAT<br>GCGCTCGCTTGGTTGCAGCAATATCGACTATCTGGTACCAAACCGTTTCGAAGA<br>CGGTTACGGCTTAAGCCCGGAAGTAGTCGATCAGGCCCATGCCCGTGGCGCGCA<br>GTTAATTGTCACGGTGGATAACGGTATTTCCTCCCATGCGGGCGTTGAACACGC<br>TCGCTCGTTGGGCATTCCGGTTATTGTTACCGATCACCATTTGCCGGGCGAAACA<br>TTACCCGCAGCGGAAGCGATCATTAACCCTAACTTGCGCGACTGTAATTTCCCG<br>TCGAAATCACTGGCAGGCGTGGGTGTGGCGTTTTATCTGATGCTGGCGCTGCGC<br>ACCTTTTTGCGCGATCAGGGCTGGTTTGATGAGCGTGGCATCGCAATTCCTAACC<br>TGGCAGAACTGCTGGATCTGGTCGCGCTGGGAACAGTGGCGGACGTCGTGCCGC<br>TGGACGCTAATAATCGCATTCTGACCTGGCAGGGGATGAGTCGCATCCGTGCCG<br>GAAAGTGCCGTCCAGGGATTAAAGCGCTGCTGGAAGTGGCAAACCGTGATGCA<br>CAAAAACTCGCCGCCAGCGATTTAGGTTTTGCGCTGGGGCCACGTCTCAATGCT<br>GCCGGACGACTGGACGATATGTCCGTCGGTGTGGCGCTCTTGCTGTGCGACAAC<br>ATCGGCGAAGCGCGCGTGCTGGCAAATGAACTCGATGCGCTAAACCAGACGCG<br>AAAAGAGATCGAACAAGGAATGCAAGTTGAAGCCCTGACCCTGTGCGAGAAAC<br>TGGAGCGAAGTCGCGACACGCTACCCGGCGGGCTGGCAATGTATCACCCCGAAT<br>GGCATCAGGGCGTTGTCGGTATTCTGGCTTCGCGCATCAAAGAGCGTTTTCACC<br>GTCCGGTTATCGCCTTTGCGCCAGCAGGTGATGGTACGCTGAAAGGTTCAGGTC<br>GCTCCATTCAGGGGCTGCATATGCGTGATGCACTGGAGCGATTAGACACACTCT<br>ACCCTGGCATGATACTGAAGTTTGGCGGTCATGCGATGGCGGCGGGTTTGTCGC<br>TGGAAGAGGATAAATTCGAACTCTTTCAACAACGGTTTGGCGAGCTGGTTACCG<br>AGTGGCTGGACCCTTCGCTATTGCAAGGCGAAGTGGTGTCAGACGGCCCGTTAA<br>GCCCGGCCGAAATGACCATGGAAGTGGCGCAGCTGCTGCGCGATGCTGGCCCGT<br>GGGGGCAGATGTTCCCGGAGCCGCTGTTTGATGGTCATTTCCGTCGCTGCAAC<br>AGCGGCTGGTGGGCGAACGTCATTTGAAAGTCATGGTCGAACCGGTCGGCGGC<br>GGTCCGCTGCTGGATGGTATTGCTTTTAATGTCGATACCGCCCTCTGGCCGGATA<br>ACGGCGTGCGCGAAGTGCAACTGGCTTACAAGCTCGATATCAACGAGTTTCGCG<br>GCAACCGCAGCCTGCAAATTATCATCGACAATATCTGGCCAATTCTGCAGAAAA<br>GGCCGGCCGGCCACGAAAAGGCCGGCCAGGCAAAAAAGAAAAAGCACCACCA<br>CCACCACCACTGA</u> | |
| 34 | MGSSHHHHHHSSGLVPRGSHMASMTGGQQMGRGSEFELRRQACGRMSIYQEFVN<br>KYSLSKTERFELIPQGKTLENIKARGLILDDEKRAKDYKKAKQIIDKYHQFFIEE<br>ILSSVCISEDLLQNYSDVYFKLKKSDDDNLQKDEKSAKDTIKKQISEYIKDSEKE<br>KNLENQNLIDAKKGQESDLIEWLKQSKDNGIELFKANSDITDIDEALEIIKSFKG<br>WTTYFKGEHENRKNVYSSNDIPTSIIYRIVDDNLPKFLENKAKYESLKDKAPEAI<br>NYEQIKKDLAEELTEDIDYKTSEVNQRVESLDEVFEIANENNYLNQSGITKENTII<br>GGKEVNGENTKRKGINEYINLYSQQINDKTEKKYKMSVLEKQILSDTESKSFVI<br>DKLEDDSDVVTTMQSFYEQIAAFKTVEEKSIKETLSELFDDLKAQKLDLSKIYF<br>KNDKSLTDESQQVFDDYSVIGTAVLEYITQQIAPKNEDNPSKKEQELIAKKTEK<br>AKYLSLETIKLALEEENKHRDIDKQCRFEEILANFAAIPMIFDEIAQNKDNLAQI<br>SIKYQNQGKKDLLQASAEDDVKAIKDELDQTNNELHKEKIFHISQSEDKANILD<br>KDEHFYLVFEECYFELANIVPLYNKIRNYITQKPYSDEKFKLNFENSTLANGWD<br>KNKEPDNTAILFIKDDKYYLGVMNKKNNKIFDDKAIKENKGEGYKKIVYKLLP<br>GANKMLPKVFFSAKSIKEYNPSEDILRIRNSHTHTKNGSPQKGYEKFEENIEDC<br>RKFIDEYKQSISKHPEWKDEGFRESDTQRYNSIDEFYREVENQGYKLTFENISES<br>YIDSVVNQGKLYLFQIYNKDFSAYSKGRPNLIITLYWKALFDERNLQDVVYKLN<br>GEAELFYRKQSIPKKITHPAKEAIANKNKDNPKKESVFEYDLIKDKRFTEDKFF<br>FHCPITINEKSSGANKENDEINELLKEKANDVHILSIDRGERHLAYYTLVDGKG<br>NIIKQDTENIIGNDRMKTNYHDKLAAIEKDRDSARKDWKKINNIKEMKEGYLS<br>QVVHEIAKLVIEYNAIVVFEDLNEGFKRGREKVEKQVYQKLEKMLIEKLNYLV<br>FKDNEFDKTGGVERAYQLTAPFETFKKMGKQTGIIYYVPAGFTSKICPVTGEV<br>NQLYPKYE SVSKSQEFFSKEDKICYNEDKGYFEFSFDYKNEGDKAAKGKWTIA<br>SEGSRLINFRNSDKNHNWDTREVYPTKELEKELKDYSIEYGHGECIKAAICGES<br>DKKFFAKLTSVENTILQMRNSKTGTELDYLISPVADVNGNFEDSRQAPKNMPQ<br>DADANGAYHIGLKGEMLLGRIKNNQEGKKLNLVIKNEEYFEFVQNRNNQAAA<br>LDLQVKQQIQLRRREVDETADLPAELPPLLRRLYASRGVRSAQELERSVKGMLPWQ<br><u>QLSGVEKAVEILYNAFREGTRIIVVGDFDADGATSTALSVLAMRSLGCSNIDYLVPN<br>RFEDGYGLSPEVVDQAHARGAQLIVTVDNGISSHAGVEHARSLGIPVIVTDHHLPGE</u> | Bold indicates FnCpf1-<br>Underlining indicates RecJ |

TABLE 7-continued

| SEQ ID NO | Sequence | Description |
|---|---|---|
| | TLPAAEAIINPNLRDCNFPSKSLAGVGVAFYLMLALRTFLRDQGWFDERGIAIPNLA ELLDLVALGTVADVVPLDANNRILTWQGMSRIRAGKCRPGIKALLEVANRDAQKL AASDLGFALGPRLNAAGRLDDMSVGVALLLCDNIGEARVLANELDALNQTRKEIE QGMQVEALTLCEKLERSRDTLPGGLAMYHPEWHQGVVGILASRIKERFHRPVIAFA PAGDGTLKGSGRSIQGLHMRDALERLDTLYPGMILKFGGHAMAAGLSLEEDKFELF QQRFGELVTEWLDPSLLQGEVVSDGPLSPAEMTMEVAQLLRDAGPWGQMFPEPLF DGHFRLLQQRLVGERHLKVMVEPVGGGPLLDGIAFNVDTALWPDNGVREVQLAY KLDINEFRGNRSLQIIIDNIWPILQKRPAATKKAGQAKKKKHHHHHH | |
| 35 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGCATGTCAATTTATCAAGAATTTGTTAA TAAATATAGTTTAAGTAAAACTCTAAGATTTGAGTTAATCCACAGGGTAAA ACACTTGAAAACATAAAAGCAAGAGGTTTGATTTTAGATGATGAGAAAGA GCTAAAGACTACAAAAAGGCTAAACAAATAATTGATAAATATCATCAGTTTT TTATAGAGGAGATATTAAGTTCGGTTTGTATTAGCGAAGATTTATTACAAAA CTATTCTGATGTTTATTTTAAACTTAAAAAGAGTGATGATGATAATCTACAA AAAGATTTTAAAAGTGCAAAAGATACGATAAAGAAACAAATATCTGAATAT ATAAAGGACTCAGAGAAATTTAAGAATTTGTTTAATCAAAACCTTATCGATG CTAAAAAAGGGCAAGAGTCAGATTTAATTCTATGGCTAAAGCAATCTAAGG ATAATGGTATAGAACTATTTAAAGCCAATAGTGATATCACAGATATAGATG AGGCGTTAGAAATAATCAAATCTTTTAAAGGTTGGACAACTTATTTTAAGG GTTTTCATGAAAATAGAAAAAATGTTTATAGTAGCAATGATATTCCTACATC TATTATTTATAGGATAGTAGATGATAATTTGCCTAAATTTCTAGAAAATAAA GCTAAGTATGAGAGTTTAAAAGACAAAGCTCCAGAAGCTATAAACTATGAA CAAATTAAAAAAGATTTGGCAGAAGAGCTAACCTTTGATATTGACTACAAA ACATCTGAAGTTAATCAAAGAGTTTTTTCACTTGATGAAGTTTTTGAGATAG CAAACTTTAATAATTATCTAAATCAAAGTGGTATTACTAAATTTAATACTAT TATTGGTGGTAAATTTGTAAATGGTGAAAATACAAAGAGAAAAGGTATAA TGAATATATAAATCTATACTCACAGCAAATAAATGATAAAACACTCAAAAAA TATAAAATGAGTGTTTTATTTAAGCAAATTTTAAGTGATACAGAATCTAAAT CTTTTGTAATTGATAAGTTAGAAGATGATAGTGATGTAGTTACAACGATGC AAAGTTTTTATGAGCAAATAGCAGCTTTTAAAACAGTAGAAGAAAAATCTA TTAAAGAAACACTATCTTTATTATTTGATGATTTAAAAGCTCAAAAACTTGA TTTGAGTAAAATTTATTTTAAAAATGATAAATCTCTTACTGATCTATCACAA CAAGTTTTTGATGATTATAGTGTTATTGGTACAGCGGTACTAGAATATATAA CTCAACAAATAGCACCTAAAAATCTTGATAACCCTAGTAAGAAAGAGCAAG AATTAATAGCCAAAAAAACTGAAAAAGCAAAATACTTATCTCTAGAAGCTAT AAAGCTTGCCTTAGAAGAATTTAATAAGCATAGAGATATAGATAAACAGTG TAGGTTTGAAGAAATACTTGCAAACTTTGCGGCTATTCCGATGATATTTGAT GAAATAGCTCAAAACAAAGACAATTTGGCACAGATATCTATCAAATATCAA AATCAAGGTAAAAAAGACCTACTTCAAGCTAGTGCGGAAGATGATGTTAAA GCTATCAAGGATCTTTTTAGATCAAACTAATAATCTCTTACATAAACTAAAAA TATTTCATATTAGTCAGTCAGAAGATAAGGCAAATATTTTAGACAAGGATG AGCATTTTTATCTAGTATTTGAGGAGTGCTACTTTGAGCTAGCGAATATAGT GCCTCTTTATAACAAAATTAGAAACTATATAACTCAAAAGCCATATAGTGAT GAGAAATTTAAGCTCAATTTTGAGAACTCGACTTTGGCTAATGGTTGGGAT AAAAATAAAGAGCCTGACAATACGGCAATTTTATTTATCAAAGATGATAAT ATTATCTGGGTGTGATGAATAAGAAAAATAACAAAATATTTGATGATAAAG CTATCAAAGAAAATAAAGGCGAGGGTTATAAAAAAATTGTTTATAAACTTTT ACCTGGCGCAAATAAAATGTTACCTAAGGTTTTCTTTTCTGCTAAATCTATA AAATTTTATAATCCTAGTGAAGATATACTTAGAATAAGAAATCATTCCACAC ATACAAAAAATGGTAGTCCTCAAAAAGGATATGAAAAATTTGAGTTTAATA TTGAAGATTGCCGAAAATTTATAGATTTTATAAACAGTCTATAAGTAAGCA TCCGGAGTGGAAAGATTTTGGATTTAGATTTTCTGATACTCAAAGATATAAT TCTATAGATGAATTTTATAGAGAAGTTGAAATCAAGGCTACAAACTAACTT TTGAAAATATATCAGAGAGCTATATTGATAGCGTAGTTAATCAGGGTAAAT TGTACCTATTCCAAATCTATAATAAAGATTTTTCAGCTTATAGCAAAGGGCG ACCAAATCTACATACTTTATATTGGAAAGCGCTGTTTGATGAGAGAAATCTT CAAGATGTGGTTTATAAGCTAAATGGTGAGGCAGAGCTTTTTATCGTAAA CAATCAATACCTAAAAAAATCACTCACCCAGCTAAAGAGGCAATAGCTAAT AAAAACAAAGATAATCCTAAAAAAGAGAGTGTTTTGAATATGATTTAATCA AAGATAAACGCTTTACTGAAGTAAGTTTTTCTTTCACTGTCCTATTACAAT CAATTTTAAATCTAGTGGAGCTAATAAGTTTAATGATGAAATCAATTTATTG CTAAAAGAAAAGCAAATGATGTTCATATATTAAGTATAGATAGAGGTGAA AGACATTTAGCTTACTATACTTTGGTAGATGGTAAAGGCAATATCATCAAA CAAGATACTTTCAACATCATTGGTAATGATAGAATGAAAACAAACTACCAT GATAAGCTTGCTGCAATAGAGAAAGATAGGGATTCAGCTAGGAAAGACTGG AAAAAGATAAATAACATCAAAGAGATGAAAGAGGGCTATCTATCTCAGGTA GTTCATGAAATAGCTAAGCTAGTTATAGAGTATAATGCTATTGTGGTTTTG AGGATTTAAATTTTGGATTTAAAAGAGGGCGTTTCAAGGTAGAGAAGCAGG TCTATCAAAAGTTAGAAAAAATGCTAATTGAGAAACTAAACTATCTAGTTTT CAAAGATAATGAGTTTGATAAAACTGGGGGAGTGCTTAGAGCTTATCAGCT AACAGCACCTTTTGAGACTTTTAAAAAGATGGGTAAACAAACAGGTATTAT CTACTATGTACCAGCTGGTTTTACTTCAAAAATTTGTCCTGTAACTGGTTTT GTAAATCAGTTATATCCTAAGTATGAAAGTGTCAGCAAATCTCAAGAGTTC | Bold indicates FnCpf1- Underlining indicates RecE |

| SEQ ID NO | Sequence | Description |
|---|---|---|
| | TTTAGTAAGTTTGACAAGATTTGTTATAACCTTGATAAGGGCTATTTTGAGT<br>TTAGTTTTGATTATAAAAACTTTGGTGACAAGGCTGCCAAAGGCAAGTGGA<br>CTATAGCTAGCTTTGGGAGTAGATTGATTAACTTTAGAAATTCAGATAAAA<br>ATCATAATTGGGATACTCGAGAAGTTTATCCAACTAAAGAGTTGGAGAAAT<br>TGCTAAAAGATTATTCTATCGAATATGGGCATGGCGAATGTATCAAAGCAG<br>CTATTTGCGGTGAGAGCGACAAAAAGTTTTTTGCTAAGCTAACTAGTGTCC<br>TAAATACTATCTTACAAATGCGTAACTCAAAAACAGGTACTGAGTTAGATTA<br>TCTAATTTCACCAGTAGCAGATGTAAATGGCAATTTCTTTGATTCGCGACA<br>GGCGCCAAAAAATATGCCTCAAGATGCTGATGCCAATGGTGCTTATCATAT<br>TGGGCTAAAAGGTCTGATGCTACTAGGTAGGATCAAAAATAATCAAGAGGG<br>CAAAAAACTCAATTTGGTTATCAAAAATGAAGAGTATTTTGAGTTCGTGCA<br>GAATAGGAATAACCAAGCGGCCGCACTCGACCTGCAGATGAGCACAAAACCA<br>CTCTTCCTGTTACGGAAAGCGAAAAAATCATCCGGTGAACCTGACGTCGTCCTG<br>TGGGCAAGCAACGATTTTGAATCGACCTGTGCCACTCTGGACTACCTGATCGTT<br>AAGTCAGGTAAAAAACTGAGCAGCTATTTTAAAGCTGTTGCCACGAATTTTCCT<br>GTCGTTAATGACCTGCCCGCTGAAGGTGAGATCGATTTTACCTGGAGTGAACGC<br>TATCAACTCAGCAAAGACTCCATGACATGGGAACTAAAACCGGGAGCAGCACC<br>AGACAACGCTCACTATCAAGGCAATACCAACGTCAACGGCGAAGACATGACTG<br>AGATTGAGGAGAATATGCTACTCCCAATTTCTGGCCAGGAACTGCCCATTCGTT<br>GGCTTGCTCAACACGGCAGCGAAAAACCGGTAACGCACGTTTCACGCGACGGA<br>CTCCAGGCATTACACATTGCTCGGGCTGAAGAACTACCGGCTGTTACTGCCCTG<br>GCTGTTTCCCACAAAACCAGCCTGCTCGACCCGCTGGAAATTCGCGAACTCCAC<br>AAACTGGTTCGTGACACTGACAAAGTTTTCCCTAATCCTGGTAATTCAAACCTG<br>GGACTGATAACTGCTTTTTTCGAAGCATACCTGAACGCTGACTACACCGATCGA<br>GGACTGCTGACAAAAGAGTGGATGAAGGGTAATCGTGTTTCACACATCACTCGC<br>ACGGCTTCCGGTGCTAATGCTGGCGGCGGAAACCTCACCGATCGCGGCGAAGGT<br>TTCGTACACGATCTGACGTCACTGGCGCGCGACGTAGCCACTGGCGTACTGGCC<br>CGTTCAATGGATCTGGACATCTATAACCTTCATCCGGCACACGCTAAACGCATT<br>GAGGAAATTATCGCTGAAAATAAACCGCCCTTTTCTGTTTTCCGCGACAAATTC<br>ATCACCATGCCTGGCGGGCTGGATTATTCCCGCGCCATCGTGGTTGCGTCCGTA<br>AAAGAAGCACCAATTGGGATCGAGGTCATCCCCGCGCACGTCACTGAATATCTG<br>AACAAAGTACTGACTGAAACCGATCATGCCAACCCTGATCCGGAAATCGTGGAT<br>ATTGCCTGCGGTCGCTCCTCTGCCCCGATGCCGCAGCGAGTAACAGAAGAAGGA<br>AAACAGGATGATGAAGAAAAACCGCAACCATCTGGAACAACGGCAGTTGAACA<br>GGGAGAGGCTGAAACAATGGAACCGGACGCAACTGAACATCATCAGGACACGC<br>AGCCGCTGGATGCTCAGTCACAGGTAAATTCTGTTGATGCGAAATATCAGGAAC<br>TGCGGGCAGAACTCCATGAAGCCCGGAAAAACATTCCATCAAAAATCCTGTCG<br>ATGACGATAAATTGCTTGCTGCATCACGTGGTGAATTTGTTGACGGAATTAGCG<br>ACCCGAACGATCCGAAATGGGTAAAGGGGATCCAGACTCGCGATTGTGTGTACC<br>AGAACCAGCCAGAAACGAAAAAACCAGCCCAGATATGAATCAACCTGAGCCA<br>GTAGTGCAACAGGAACCGGAAATAGCCTGCAATGCCTGCGGCCAGACTGGCGG<br>GGATAACTGCCCTGACTGTGGTGCGGTGATGGGCGACGCAACATACCAGGAAA<br>CATTCGATGAAGAGAGTCAGGTTGAAGCTAAGGAAAATGATCCGGAGGAAATG<br>GAAGGCGCTGAACATCCGCACAATGAGAATGCTGGCAGCGATCCGCATCGCGA<br>TTGCAGTGATGAAACTGGCGAAGTCGCAGATCCCGTAATCGTAGAAGACATAG<br>AGCCAGGTATTTATTACGGAATTTCGAATGAGAATTACCACGCGGGTCCCGGTA<br>TCAGTAAGTCTCAGCTCGATGACATTGCTGATACTCCGGCACTATATTTGTGGCG<br>TAAAAATGCCCCCGTGGACACCACAAAGACAAAAACGCTCGATTTAGGAACTG<br>CTTTCCACTGCCGGGTACTTGAACCGGAAGAATTCAGTAACCGCTTTATCGTAG<br>CACCTGAATTTAACCGCCGTACAAACGCCGGAAAAGAAGAAGAGAAAGCGTTT<br>CTGATGGAATGCGCAAGCACAGGAAAAACGGTTATCACTGCGGAAGAAGGCCG<br>GAAAATTGAACTCATGTATCAAAGCGTTATGGCTTTGCCGCTGGGGCAATGGCT<br>TGTTGAAAGCGCCGGACACGCTGAATCATCAATTTACTGGGAAGATCCTGAAAC<br>AGGAATTTTGTGTCGGTGCCGTCCGGACAAAATTATCCCTGAATTTCACTGGATC<br>ATGGACGTGAAAACTACGCGGATATTCAACGATTCAAAACCGCTTATTACGAC<br>TACCGCTATCACGTTCAGGATGCATTCTACAGTGACGGTTATGAAGCACAGTTT<br>GGAGTGCAGCCAACTTTCGTTTTTCTGGTTGCCAGCACAACTATTGAATGCGGA<br>CGTTATCCGGTTGAAATTTTCATGATGGGCGAAGAAGCAAAACTGGCAGGTCAA<br>CAGGAATATCACCGCAATCTGCGAACCCTGTCTGACTGCCTGAATACCGATGAA<br>TGGCCAGCTATTAAGACATTATCACTGCCCCGCTGGGCTAAGGAATATGCAAAT<br>GACCTGCAGAAAGGCCGGCGGCCACGAAAAAGGCCGGCCAGGCAAAAAGA<br>AAAAGCACCACCACCACCACTGA | |
| 36 | MGSSHHHHHHSSGLVPRGSHMASMTGGQQMGRGSEFELRRQACGRMSIYQEFVN<br>KYSLSKTLRFELIPQGKTLENIKARGLILDDEKRAKDYKKAKQIIDKYHQFFIEE<br>ILSSVCISEDLLQNYSDVYFKLKKSDDDNLQKDFKSAKDTIKKQISEYIKDSEKF<br>KNLFNQNLIDAKKGQESDLILWLKQSKDNGIELFKANSDITDIDEALEIIKSFKG<br>WTTYYFKGFHENRKNVYSSNDIPTSHYRIVDDNLPKFLENKAKYESLKDKAPEAI<br>NYEQIKKDLAEELTFDIDYKTSEVNQRVFSLDEVFEIANFNNYLNQSGITKFNTII<br>GGKFVNGENTKRKGINEYINLYSQQINDKTLKKYKMSVLFKQILSDTESKSFVI<br>DKLEDDSDVVTTMQSFYEQIAAFKTVEEKSIKETLSLLFDDLKAQKLDLSKIYF<br>KNDKSLTDLSQQVFDDYSVIGTAVLEYITQQIAPKNLDNPSKKEQELIAKKTEK<br>AKYLSLETIKLALEEFNKHRDIDKQCRFEEILANFAAIPMIFDEIAQNKDNLAQI<br>SIKYQNQGKKDLLQASAEDDVKAIKDLLDQTNNLLHKLKIFHISQSEDKANILD<br>KDEHFYLVFEECYFELANIVPLYNKIRNYITQKPYSDEKFKLNFENSTLANGWD<br>KNKEPDNTAILFIKDDKYYLGVMNKKNNKIFDDKAIKENKGEGYKKIVYKLLP | Bold indicates FnCpf1-<br>Underlining indicates RecE |

TABLE 7-continued

| SEQ ID NO | Sequence | Description |
|---|---|---|
| | GANKMLPKVFFSAKSIKFYNPSEDILRIRNHSTHTKNGSPQKGYEKFEFNIEDC<br>RKFIDFYKQSISKHPEWKDFGFRFSDTQRYNSIDEFYREVENQGYKLTFENISES<br>YIDSVVNQGKLYLFQIYNKDFSAYSKGRPNLHTLYWKALFDERNLQDVVYKLN<br>GEAELFYRKQSIPKKITHPAKEAIANKNKDNPKKESVFEYDLIKDKRFTEDKFF<br>FHCPITINFKSSGANKFNDEINLLLKEKANDVHILSIDRGERHLAYYTLVDGKG<br>NIIKQDTFNIIGNDRMKTNYHDKLAAIEKDRDSARKDWKKINNIKEMKEGYLS<br>QVVHEIAKLVIEYNAIVVFEDLNFGFKRGRFKVEKQVYQKLEKMLIEKLNYLV<br>FKDNEFDKTGGVLRAYQLTAPFETFKKMGKQTGIIYYVPAGFTSKICPVTGFV<br>NQLYPKYESVSKSQEFFSKFDKICYNLDKGYFEFSFDYKNFGDKAAKGKWTIA<br>SFGSRLINFRNSDKNHNWDTREVYPTKELEKLLKDYSIEYGHGECIKAAICGES<br>DKKFFAKLTSVLNTILQMRNSKTGTELDYLISPVADVNGNFFDSRQAPKNMPQ<br>DADANGAYHIGLKGLMLLGRIKNNQEGKKLNLVIKNEEYFEFVQNRNNQAAA<br><u>LDLQMSTKPLFLLRKAKKSSGEPDVVLWASNDFESTCATLDYLIVKSGKKLSSYFK</u><br><u>AVATNFPVVNDLPAEGEIDFTWSERYQLSKDSMTWELKPGAAPDNAHYQGNTNVN</u><br><u>GEDMTEIEENMLLPISGQELPIRWLAQHGSEKPVTHVSRDGLQALHIARAEELPAVT</u><br><u>ALAVSHKTSLLDPLEIRELHKLVRDTDKVFPNPGNSNLGLITAFFEAYLNADYTDRG</u><br><u>LLTKEWMKGNRVSHITRTASGANAGGGNLTDRGEGFVHDLTSLARDVATGVLARS</u><br><u>MDLDIYNLHPAHAKRIEEIIAENKPPFSVFRDKFITMPGGLDYSRAIVVASVKEAPIGI</u><br><u>EVIPAHVTEYLNKVLTETDHANPDPEIVDIACGRSSAPMPQRVTEEGKQDDEEKPQP</u><br><u>SGTTAVEQGEAETMEPDATEHHQDTQPLDAQSQVNSVDAKYQELRAELHEARKNI</u><br><u>PSKNPVDDDKLLAASRGEFVDGISDPNDPKWVKGIQTRDCVYQNQPEIEKTSPDMN</u><br><u>QPEPVVQQEPEIACNACGQTGGDNCPDCGAVMGDATYQETFDEESQVEAKENDPE</u><br><u>EMEGAEHPHNENAGSDPHRDCSDETGEVADPVIVEDIEPGIYYGISNENYHAGPGIS</u><br><u>KSQLDDTADTPALYLWRKNAPVDTTKTLDLGTAFHCRVLEPEEFSNRFIVAPEFN</u><br><u>RRTNAGKEEEKAFLMECASTGKTVITAEEGRKIELMYQSVMALPLGQWLVESAGH</u><br><u>AESSIYWEDPETGILCRCRPDKIIPEFHWIMDVKTTADIQRFKTAYYDYRYHVQDAF</u><br><u>YSDGYEAQFGVQPTFVFLVASTTIECGRYPVEIFMMGEEAKLAGQQEYHRNLRTLS</u><br><u>DCLNTDEWPAIKTLSLPRWAKEYANDLQKRPAATKKAGQAKKKKHHHHHH</u> | |
| 37 | ATGGGCAGCAGCCATCATCATCATCATCACAGCAGCGGCCTGGTGCCGCGCGG<br>AGCCATATGGCTAGCATGACTGGTGGACAGCAAATGGGTCGCGGATCCGAATTC<br>GAGCTCCGTCGACAAGCTTGCGGCCGCATGTCAATTTATCAAGAATTTGTTAA<br>TAAATATAGTTTAAGTAAAACTCTAAGATTTGAGTTAATCCCACAGGGTAAA<br>ACACTTGAAAACATAAAAGCAAGAGGTTTGATTTTAGATGATGAGAAAGA<br>GCTAAAGACTACAAAAAGGCTAAACAAATAATTGATAAATATCATCAGTTTT<br>TTATAGAGGAGATATTAAGTTCGGTTTGTATTAGCGAAGATTATTACAAAA<br>CTATTCTGATGTTTATTTTAAACTTAAAAGAGTGATGATGATAATCTACAA<br>AAAGATTTTAAAAGTGCAAAAGATACGATAAAGAAACAAATATCTGAATAT<br>ATAAAGGACTCAGAGAAATTTAAGAATTTGTTTAATCAAAACCTTATCGATG<br>CTAAAAAAGGGCAAGAGTCAGATTTAATTCTATGGCTAAAGCAATCTAAGG<br>ATAATGGTATAGAACTATTTAAAGCCAATAGTGATATCACAGATATAGATG<br>AGGCGTTAGAAAATCAAATCTTTTAAAGGTTGGACAACTTATTTTAAGG<br>GTTTTCATGAAAATAGAAAAATGTTTATAGTAGCAATGATATTCCTACATC<br>TATTATTATAGGATAGTAGATGATAATTTGCCTAAATTTCTAGAAAATAAA<br>GCTAAGTATGAGAGTTTAAAAGACAAAGCTCCAGAAGCTATAAACTATGAA<br>CAAATTAAAAAAGATTTGGCAGAAGAGCTAACCTTTGATATTGACTACAAA<br>ACATCTGAAGTTAATCAAAGAGTTTTTTCACTTGATGAAGTTTTTGAGATAG<br>CAAACTTTAATAATTATCTAAATCAAAGTGGTATTACTAAATTAATACTAT<br>TATTGGTGGTAAATTTGTAAATGGTGAAAATACAAAGAGAAAAGGTATAAA<br>TGAATATATAAATCTATACTCACAGCAAATAAATGATAAAACACTCAAAAAA<br>TATAAATGAGTGTTTTATTTAAGCAAATTTTAAGTGATACAGAATCTAAAT<br>CTTTTGTAATTGATAAGTTAGAAGATGATAGTGATGTAGTTACAACGATGC<br>AAAGTTTTTATGAGCAAATAGCAGCTTTTAAAACAGTAGAAGAAAATCTA<br>TTAAAGAAACACTATCTTTATTATTTGATGATTTAAAAGCTCAAAAACTTGA<br>TTTGAGTAAAATTTATTTTAAAAATGATAAATCTCTTACTGATCTATCACAA<br>CAAGTTTTTGATGATTATAGTGTTATTGGTACAGCGGTACTAGAATATATAA<br>CTCAACAAATAGCACCTAAAAATCTTGATAACCCTAGTAAGAAAGAGCAAG<br>AATTAATAGCCAAAAAAACTGAAAAAGCAAAATACTTATCTCTAGAAACTAT<br>AAAGCTTGCCTTAGAAGAATTTAATAAGCATAGAGATATAGATAAACAGTG<br>TAGGTTTGAAGAAATACTTGCAAACTTTGCGGCTATTCCGATGATATTTGAT<br>GAAATAGCTCAAAACAAAGACAATTTGGCACAGATATCTATCAAATATCAA<br>AATCAAGGTAAAAAAGACCTACTTCAAGCTAGTGCGGAAGATGATGTTAAA<br>GCTATCAAGGATCTTTTAGATCAAACTAATAATCTCTTACATAAACTAAAA<br>TATTTCATATTAGTCAGTCAGAAGATAAGGCAAATATTTTAGACAAGGATG<br>AGCATTTTTATCTAGTATTTGAGGAGTGCTACTTTGAGCTAGCGAATATAGT<br>GCCTCTTTATAACAAAATTAGAAACTATATAACTCAAAAGCCATATAGTGAT<br>GAGAAATTTAAGCTCAATTTTGAGAACTCGACTTTGGCTAATGGTTGGGAT<br>AAAAATAAAGAGCCTGACAATACGGCAATTTTATTTATCAAAGATGATAAAT<br>ATTATCTGGGTGTGATGAATAAGAAAAATAACAAAATATTTGATGATAAAG<br>CTATCAAAGAAATAAAGGCGAGGGTTATAAAAAAATTGTTTATAAACTTTT<br>ACCTGGCGCAAATAAAATGTTACCTAAGGTTTTCTTTTCTGCTAAATCTATA<br>AAATTTTATAATCCTAGTGAAGATATACTTAGAATAAGAAATCATTCCACAC<br>ATACAAAAAATGGTAGTCCTCAAAAAGGATATGAAAAATTTGAGTTTAATA<br>TTGAAGATTGCCGAAAATTTATAGATTTTTATAAACAGTCTATAAGTAAGCA<br>TCCGGAGTGGAAAGATTTTGGATTTAGATTTTCTGATACTCAAAGATATAAT<br>TCTATAGATGAATTTTATAGAGAAGTTGAAAATCAAGGCTACAAACTAACTT | Bold indicates FnCpf1-<br>Underlining indicates hTdT |

TABLE 7-continued

| SEQ ID NO | Sequence | Description |
|---|---|---|
| | TTGAAAATATATCAGAGAGCTATATTGATAGCGTAGTTAATCAGGGTAAAT<br>TGTACCTATTCCAAATCTATAATAAAGATTTTTCAGCTTATAGCAAAGGGCG<br>ACCAAATCTACATACTTTATATTGGAAAGCGCTGTTTGATGAGAGAAATCTT<br>CAAGATGTGGTTTATAAGCTAAATGGTGAGGCAGAGCTTTTTTATCGTAAA<br>CAATCAATACCTAAAAAAATCACTCACCCAGCTAAAGAGGCAATAGCTAAT<br>AAAAACAAAGATAATCCTAAAAAAGAGAGTGTTTTGAATATGATTAATCA<br>AAGATAAACGCTTTACTGAAGATAAGTTTTTCTTTCACTGTCCTATTACAAT<br>CAATTTTAAATCTAGTGGAGCTAATAAGTTTAATGATGAAATCAATTTATTG<br>CTAAAAGAAAAAGCAAATGATGTTCATATATTAAGTATAGATAGAGGTGAA<br>AGACATTTAGCTTACTATACTTTGGTAGATGGTAAAGGCAATATCATCAAA<br>CAAGATACTTTCAACATCATTGGTAATGATAGAATGAAAACAAACTACCAT<br>GATAAGCTTGCTGCAATAGAAAGATAGGGATTCAGCTAGGAAAGACTGG<br>AAAAAGATAAATAACATCAAAGAGATGAAAGAGGGCTATCTATCTCAGGTA<br>GTTCATGAAATAGCTAAGCTAGTTATAGAGTATAATGCTATTGTGGTTTTTG<br>AGGATTTAAATTTTGGATTTAAAAGAGGGCGTTTCAAGGTAGAGAAGCAGG<br>TCTATCAAAGTTAGAAAAATGCTAATTGAGAAACTAAACTATCTAGTTTT<br>CAAAGATAATGAGTTTGATAAAACTGGGGAGTGCTTAGAGCTTATCAGCT<br>AACAGCACCTTTTGAGACTTTTAAAAAGATGGGTAAACAAACAGGTATTAT<br>CTACTATGTACCAGCTGGTTTTACTTCAAAAATTTGTCCTGTAACTGGTTTT<br>GTAAATCAGTTATATCCTAAGTATGAAAGTGTCAGCAAATCTCAAGAGTTC<br>TTTAGTAAGTTTGACAAGATTTGTTATAACCTTGATAAGGGCTATTTTGAGT<br>TTAGTTTTGATTATAAAAACTTTGGTGACAAGGCTGCCAAAGGCAAGTGGA<br>CTATAGCTAGCTTTGGGAGTAGATTGATTAACTTTAGAAATTCAGATAAAA<br>ATCATAATTGGGATACTCGAGAAGTTTATCCAACTAAAGAGTTGGAGAAAT<br>TGCTAAAAGATTATTCTATCGAATATGGGCATGGCGAATGTATCAAAGCAG<br>CTATTTGCGGTGAGAGCGACAAAAAGTTTTTTGCTAAGCTAACTAGTGTCC<br>TAAATACTATCTTACAAATGCGTAACTCAAAAACAGGTACTGAGTTAGATTA<br>TCTAATTTCACCAGTAGCAGATGTAAATGGCAATTTCTTTGATTCGCACA<br>GGCGCCAAAAAATATGCCTCAAGATGCTGATGCCAATGGTGCTTATCATAT<br>TGGGCTAAAAGGTCTGATGCTACTAGGTAGGATCAAAAATAATCAAGAGGG<br>CAAAAAACTCAATTTGGTTATCAAAAATGAAGAGTATTTTGAGTTCGTGCA<br>GAATAGGAATAACCAAGCGGCCGCACTCGACCTCGAG<u>ATGGATCCACCACGAG<br>CGTCCCACTTGAGCCCTCGGAAGAAGAGACCCCGGCAGACGGGTGCCTTGATGG<br>CCTCCTCTCCTCAAGACATCAAATTTCAAGATTTGGTCGTCTTCATTTTGGAGAA<br>GAAAATGGGAACCACCCGCAGAGCGTTCCTCATGGAGCTGGCCCGCAGGAAAG<br>GGTTCAGGGTTGAAAATGAGCTCAGTGATTCTGTCACCCACATTGTAGCAGAGA<br>ACAACTCGGGTTCGGATGTTCTGGAGTGGCTTCAAGCACAGAAAGTACAAGTCA<br>GCTCACAACCAGAGCTCCTCGATGTCTCCTGGCTGATCGAATGCATAGGAGCAG<br>GGAAACCGGTGGAAATGACAGGAAAACACCAGCTTGTTGTGAGAAGAGACTAT<br>TCAGATAGCACCAACCCAGGCCCCCGAAGACTCCACCAATTGCTGTACAAAAG<br>ATCTCCCAGTATGCGTGTCAGAGAAGAACCACTTTAAACAACTGTAACCAGATA<br>TTCACGGATGCCTTTGATATACTGGCTGAAAACTGTGAGTTTAGAGAAAATGAA<br>GACTCCTGTGTGACATTTATGAGCAGCTTCTGTATTGAAATCTCTGCCATTCA<br>CAATCATCAGTATGAAGGACACAGAAGGAATTCCCTGCCTGGGGTCCAAGGTG<br>AAGGGTATCATAGAGGAGATTATTGAAGATGGAGAAAGTTCTGAAGTTAAAGC<br>TGTGTTAAATGATGAACGATATCAATCCTTCAAACTCTTTACTTCTGTATTTGGA<br>GTGGGGCTGAAGACTTCTGAGAAGTGGTTCAGGATGGGTTTCAGAACTCTGAGT<br>AAAGTAAGGTCGGACAAAAGCCTGAAATTTACACGAATGCAGAAAGCAGGATT<br>TCTGTATTATGAAGCCTTGTCAGCTGTGTGACCAGGGCAGAAGCAGAGGCCGT<br>CAGTGTGCTGGTTAAAGAGGCTGTCTGGGCATTTCTTCCGGATGCTTTCGTCACC<br>ATGACAGGAGGGTTCCGGAGGGGTAAGAAGATGGGGCATGATGTAGATTTTTT<br>AATTACCAGCCCAGGATCAACGAGGATGAAGAGCAACTTTTACAGAAAGTGA<br>TGAACTTATGGGAAAAGAAGGGATTACTTTTATATTATGACCTTGTGGAGTCAA<br>CATTTGAAAAGCTCAGGTTGCCTAGCAGGAAGGTTGATGCTTTGGATCATTTTC<br>AAAAGTGCTTTCTGATTTTCAAATTGCCTCGTCAAAGAGTGGACAGTGACCAGT<br>CCAGCTGGCAGGAAGGAAAGACCTGGAAGGCCATCCGTGTGGATTTAGTTCTGT<br>GCCCCTACGAGCGTCGTGCCTTTGCCCTGTTGGGATGGACTGGCTCCCGGCAGTT<br>TGAGAGACCTCCGGCGCTATGCCACACATGAGCGGAAGATGATTCTGGATA<br>ACCATGCTTTATATGACAAGACCAAGAGGATATTCCTCAAAGCAGAAAGTGAA<br>GAAGAAATTTTTGCGCATCTGGGATTGGATTATATTGAACCGTGGGAAAGAAAT<br>GCCCTCGAGAAAAGGCCGGCGGCCACGAAAAAGGCCGGCCAGGCAAAAAGA<br>AAAAGCACCACCACCACCACTGA</u> | |
| 38 | MGSSHHHHHHSSGLVPRGSHMASMTGGQQMGRGSEFELRRQACGRMSIYQEFVN<br>KYSLSKTERFELIPQGKTLENIKARGLILDDEKRAKDYKKAKQIIDKYHQFFIEE<br>ILSSVCISEDLLQNYSDVYFKLKKSDDDNLQKDEKSAKDTIKKQISEYIKDSEKE<br>KNLENQNLIDAKKGQESDLIEWLKQSKDNGIELFKANSDITDEALEIIKSFKG<br>WTTYFKGEHENRKNVYSSNDIPTSIIYRIVDDNLPKFLENKAKYESLKDAPEAI<br>NYEQIKKDLAEELTEDIDYKTSEVNQRVESLDEVFEIANENNYLNQSGITKENTII<br>GGKEVNGENTKRKGINEYINLYSQQINDKTEKKYKMSVLEKQILSDTESKSFVI<br>DKLEDDSDVVTTMQSFYEQIAAFKTVEEKSIKETLSELFDDLKAQKLDLSKIYF<br>KNDKSLTDESQQVFDDYSVIGTAVLEYITQQIAPKNEDNPSKKEQELIAKKTEK<br>AKYLSLETIKLALEEENKHRDIDKQCRFEEILANFAAIPMIFDEIAQNKDNLAQI<br>SIKYQNQGKKDLLQASAEDDVKAIKDELDQTNNELHKEKIFHISQSEDKANILD<br>KDEHFYLVFEECYFELANIVPLYNKIRNYITQKPYSDEKFKLNFENSTLANGWD<br>KNKEPDNTAILFIKDDKYYLGVMNKKNNKIFDDKAIKENKGEGYKKIVYKLLP | Bold indicates FnCpf1-<br>Underlining indicates hTdT |

TABLE 7-continued

| SEQ ID NO | Sequence | Description |
|---|---|---|
| | GANKMLPKVFFSAKSIKEYNPSEDILRIRNHSTHTKNGSPQKGYEKFEENIEDC RKFIDEYKQSISKHPEWKDEGFRESDTQRYNSIDEFYREVENQGYKLTFENISES YIDSVVNQGKLYLFQIYNKDFSAYSKGRPNLIITLYWKALFDERNLQDVVYKLN GEAELFYRKQSIPKKITHPAKEAIANKNKDNPKKESVFEYDLIKDKRFTEDKFF FHCPITINEKSSGANKENDEINELLKEKANDVHILSIDRGERHLAYYTLVDGKG NIIKQDTENIIGNDRMKTNYHDKLAAIEKDRDSARKDWKKINNIKEMKEGYLS QVVHEIAKLVIEYNAIVVFEDLNEGFKRGREKVEKQVYQKLEKMLIEKLNYLV FKDNEFDKTGGVERAYQLTAPFETFKKMGKQTGIIYYVPAGFTSKICPVTGEV NQLYPKYESVSKSQEFFSKEDKICYNEDKGYFEFSFDYKNEGDKAAKGKWTIA SFGSRLINFRNSDKNHNWDTREVYPTKELEKELKDYSIEYGHGECIKAAICGES DKKFFAKETSVENTILQMRNSKTGTELDYLISPVADVNGNFEDSRQAPKNMPQ DADANGAYHIGLKGEMLLGRIKNNQEGKKLNLVIKNEEYFEFVQNRNN<u>QAAA LDLEMDPPRASHLSPRKKRPRQTGALMASSPQDIKFQDLVVFILEKKMGTTRRAFL MELARRKGFRVENELSDSVTHIVAENNSGSDVLEWLQAQKVQVSSQPELLDVSWLI ECIGAGKPVEMTGKHQLVVRRDYSDSTNPGPPKTPPIAVQKISQYACQRRTTLNNC NQIFTDAFDILAENCEFRENEDSCVTFMRAASVLKSLPFTIISMKDTEGIPCLGSKVK GIIEEIIEDGESSEVKAVLNDERYQSFKLFTSVFGVGLKTSEKWFRMGFRTLSKVRSD KSLKFTRMQKAGFLYYEDLVSCVTRAEAEAVSVLVKEAVWAFLPDAFVTMTGGFR RGKKMGHDVDFLITSPGSTEDEEQLLQKVMNLWEKKGLLLYYDLVESTFEKLRLPS RKVDALDHFQKCFLIFKLPRQRVDSDQSSWQEGKTWKAIRVDLVLCPYERRAFALL GWTGSRQFERDLRRYATHERKMILDNHALYDKTKRIFLKAESEEEIFAHLGLDYIEP WERNALEKRPAATKKAGQAKKKKHHHH</u> | |
| 39 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGCATGTCAATTTATCAAGAATTTGTTAA TAAATATAGTTTAAGTAAAACTCTAAGATTTGAGTTAATCCCACAGGGTAAA ACACTTGAAAACATAAAAGCAAGAGGTTTGATTTTAGATGATGAGAAAAGA GCTAAAGACTACAAAAAGGCTAAACAAATAATTGATAAATATCATCAGTTTT TTATAGAGGAGATATTAAGTTCGGTTTGTATTAGCGAAGATTATTACAAAA CTATTCTGATGTTTATTTTAAACTTAAAAAGAGTGATGATGATAATCTACAA AAAGATTTTAAAAGTGCAAAAGATACGATAAAGAAACAAATATCTGAATAT ATAAAGGACTCAGAGAAATTTAAGAATTTGTTTAATCAAAACCTTATCGATG CTAAAAAAGGGCAAGAGTCAGATTTAATTCTATGGCTAAAGCAATCTAAGG ATAATGGTATAGAACTATTTAAAGCCAATAGTGATATCACAGAATATAGATG AGGCGTTAGAAATAATCAAATCTTTTAAAGGTTGGACAACTTATTTTAAGG GTTTTCATGAAAATAGAAAAAATGTTTATAGTAGCAATGATATTCCTACATC TATTATTTATAGGATAGTAGATGATAATTTGCCTAAATTTCTAGAAAATAAA GCTAAGTATGAGAGTTTAAAAGACAAAGCTCCAGAAGCTATAAACATATGAA CAAATTAAAAAAGATTTGGCAGAAGAGCTAACCTTTGATATTGACTACAAA ACATCTGAAGTTAATCAAAGAGTTTTTTCACTTGATGAAGTTTTTGAGATAG CAAACTTTAATAATTATCTAAATCAAAGTGGTATTACTAAATTTAATACTAT TATTGGTGGTAAATTTGTAAATGGTGAAAATACAAAGAGAAAAGGTATAAA TGAATATATAAATCTATACTCACAGCAAATAAATGATAAAACACTCAAAAAA TATAAAATGAGTGTTTTATTTAAGCAAATTTTAAGTGATACAGAATCTAAAT CTTTTGTAATTGATAAGTTAGAAGATGATAGTGATGTAGTTCAACGATGC AAAGTTTTTATGAGCAAATAGCAGCTTTTAAAACAGTAGAAGAAAATCTA TTAAAGAAACACTATCTTTATTATTTGATGATTTAAAAGCTCAAAAACTTGA TTTGAGTAAAATTTATTTTAAAAATGATAAATCTCTTACTGATCTATCACAA CAAGTTTTTGATGATTATATAGTGTTATTGGTACAGCGGTACTAGAATATATAA CTCAACAAATAGCACCTAAAAATCTTGATAACCCTAGTAAGAAAGAGCAAG AATTAATAGCCAAAAAAACTGAAAAAGCAAATACTTATCTCTAGAAACTAT AAAGCTTGCCTTAGAAGAATTTAATAAGCATAGAGATATAGATAAACAGTG TAGGTTTGAAGAAATACTTGCAAACTTTGCGGCTATTCCGATGATATTTGAT GAAATAGCTCAAAACAAAGACAATTTGGCACAGATATCTATCAAATATCAA AATCAAGGTAAAAAAGACCTACTTCAAGCTAGTGCGGAAGATGATGTTAAA GCTATCAAGGATCTTTTAGATCAAACTAATAATCTCTTACATAAACTAAAAA TATTTCATATTAGTCAGTCAGAAGATAAGGCAAATATTTTAGACAAGGATG AGCATTTTTATCTAGTATTTGAGGAGTGCTACTTTGAGCTAGCGAATATAGT GCCTCTTTATAACAAAATTAGAAACTATATAACTCAAAAGCCATATAGTGAT GAGAAATTTAAGCTCAATTTTGAGAACTCGACTTTGGCTAATGGTTGGGAT AAAAATAAAGAGCCTGACAATACGGCAATTTTATTTATCAAAGATGATAAAT ATTATCTGGGTGTGATGAATAAGAAAAATAACAAAATATTTGATGATAAAG CTATCAAAGAAAATAAAGGCGAGGGTTATAAAAAAATTGTTTATAAACTTTT ACCTGGCGCAAATAAATGTTACCTAAGGTTTTCTTTTCTGCTAAATCTATA AAATTTTATAATCCTAGTGAAGATATACTTAGAATAAGAAATCATTCCACAC ATACAAAAAATGGTAGTCCTCAAAAAGGATATGAAAAATTTGAGTTTAATA TTGAAGATTGCCGAAAATTTATAGATTTTTATAAACAGTCTATAAGTAAGCA TCCGGAGTGGAAAGATTTTGGATTTAGATTTTCTGATACTCAAAGATATAAT TCTATAGATGAATTTATAGAGAAGTTGAAAATCAAGGCTACAAACTAACTT TTGAAAATATATCAGAGAGCTATATTGATAGCGTAGTTAATCAGGGTAAAT TGTACCTATTCCAAATCTATAATAAAGATTTTTCAGCTTATAGCAAAGGGCG ACCAAATCTACATACTTTATATTGGAAAGCGCTGTTTGATGAGAGAAATCTT CAAGATGTGGTTTATAAGCTAAATGGTGAGGCAGAGCTTTTTTATCGTAAA CAATCAATACCTAAAAAAATCACTCACCCAGCTAAAGAGGCAATAGCTAAT AAAAACAAAGATAATCCTAAAAAAGAGAGTGTTTTTGAATATGATTTAATCA | Bold indicates FnCpf1- Underlining indicates T5 |

TABLE 7-continued

| SEQ ID NO | Sequence | Description |
|---|---|---|
| | AAGATAAACGCTTTACTGAAGATAAGTTTTTCTTTCACTGTCCTATTACAAT CAATTTTAAATCTAGTGGAGCTAATAAGTTTAATGATGAAATCAATTTATTG CTAAAAGAAAAAGCAAATGATGTTCATATATTAAGTATAGATAGAGGTGAA AGACATTTAGCTTACTATACTTTGGTAGATGGTAAAGGCAATATCATCAAA CAAGATACTTTCAACATCATTGGTAATGATAGAATGAAAACAAACTACCAT GATAAGCTTGCTGCAATAGAGAAAGATAGGGATTCAGCTAGGAAAGACTGG AAAAAGATAAATAACATCAAAGAGATGAAAGAGGGCTATCTATCTCAGGTA GTTCATGAAATAGCTAAGCTAGTTATAGAGTATAATGCTATTGTGGTTTTG AGGATTTAAATTTTGGATTTAAAAGAGGGCGTTTCAAGGTAGAGAAGCAGG TCTATCAAAAGTTAGAAAAAATGCTAATTGAGAAACTAAACTATCTAGTTTT CAAAGATAATGAGTTTGATAAAACTGGGGGAGTGCTTAGAGCTTATCAGCT AACAGCACCTTTTGAGACTTTTAAAAAGATGGGTAAACAAACAGGTATTAT CTACTATGTACCAGCTGGTTTTACTTCAAAAATTTGTCCTGTAACTGGTTTT GTAAATCAGTTATATCCTAAGTATGAAAGTGTCAGCAAATCTCAAGAGTTC TTTAGTAAGTTTGACAAGATTTGTTATAACCTTGATAAGGGCTATTTTGAGT TTAGTTTTGATTATAAAAACTTTGGTGACAAGGCTGCCAAAGGCAAGTGGA CTATAGCTAGCTTTGGGAGTAGATTGATTAACTTTAGAAATTCAGATAAAA ATCATAATTGGGATACTCGAGAAGTTTATCCAACTAAAGAGTTGGAGAAAT TGCTAAAAGATTATTCTATCGAATATGGGCATGGCGAATGTATCAAAGCAG CTATTTGCGGTGAGAGCGACAAAAAGTTTTTTGCTAAGCTAACTAGTGTCC TAAATACTATCTTACAAATGCGTAACTCAAAAACAGGTACTGAGTTAGATTA TCTAATTTCACCAGTAGCAGATGTAAATGGCAATTTCTTTGATTCGCGACA GGCGCCAAAAAATATGCCTCAAGATGCTGATGCCAATGGTGCTTATCATAT TGGGCTAAAAGGTCTGATGCTACTAGGTAGGATCAAAAATAATCAAGAGGG CAAAAAACTCAATTTGGTTATCAAAAATGAAGAGTATTTTGAGTTCGTGCA GAATAGGAATAACCAAGCGGCCGCACTCGACCTGCAG<u>ATGGCTTCCCGTCGTA ATCTAATGATTGTCGATGGAACTAACTTAGGCTTTCGCTTCAAACATAACAATA GTAAAAAACCATTTGCCTCAAGTTATGTTTCAACTATTCAATCTCTGGCAAAATC CTACTCTGCCAGAACTACGATTGTTCTAGGTGATAAGGGAAAATCTGTATTTCGT CTAGAACATCTACCAGAGTATAAAGGTAATCGTGATGAAAAGTACGCACAACG TACGGAAGAGGAGAAAGCGCTAGATGAGCAGTTCTTTGAGTATTTGAAGGATG CTTTCGAGTTGTGTAAAACTACATTCCCAACTTTTACCATTCGTGGTGTAGAAGC AGACGATATGGCAGCTTATATTGTTAAGCTCATCGGGCATCTTTATGATCACGTT TGGCTAATATCTACAGATGGTGACTGGGATACTTTATTAACGGATAAAGTTTCTC GTTTTTCTTTCACAACACGTCGTGAGTATCATCTTCGTGATATGTATGAACATCA TAATGTTGATGATGTTGAGCAGTTTATCTCCCTGAAAGCAATTATGGGAGATCT AGGAGATAATATTCGTGGTGTTGAAGGAATAGGAGCAAAACGCGGATATAATA TTATTCGTGAGTTTGGTAACGTACTGGATATTATTGATCAGCTTCCACTGCCTGG AAAGCAGAAATATATACAGAACCTGAATGCATCGGAAGAACTGCTTTTCCGAA ACTTGATTCTGGTTGATTTACCTACCTACTGTGTGGATGCTATTGCTGCTGTAGG TCAAGATGTGTTAGATAAGTTTACAAAAGATATTTTGGAGATTGCAGAACAACT GCAGAAAAGGCCGGCGGCCACGAAAAAGGCCGGCCAGGCAAAAAGAAAAAG CACCACCACCACCACTGA</u> | |
| 40 | MGSSHHHHHHSSGLVPRGSHMASMTGGQQMGRGSEFELRRQACGRMSIYQEFVN KYSLSKTERFELIPQGKTLENIKARGLILDDEKRAKDYKKAKQIIDKYHQFFIEE ILSSVCISEDLLQNYSDVYFKLKKSDDDNLQKDEKSAKDTIKKQISEYIKDSEKE KNLENQNLIDAKKGQESDLIEWLKQSKDNGIELFKANSDITDIDEALEIIKSPKG WTTYFKGEHENRKNVYSSNDIPTSIIYRIVDDNLPKFLENKAKYESLKDKAPEAI NYEQIKKDLAEELTEDIDYKTSEVNQRVESLDEVFEIANENNYLNQSGITKENTII GGKEVNGENTKRKGINEYINLYSQQINDKTEKKYKMSVLEKQILSDTESKSFVI DKLEDDSDVVTTMQSFYEQIAAFKTVEEKSIKETLSELFDDLKAQKLDLSKIYF KNDKSLTDESQQVFDDYSVIGTAVLEYITQQIAPKNEDNPSKKEQELIAKKTEK AKYLSLETIKLALEEFNKHRDIDKQCRFEEILANFAAIPMIFDEIAQNKDNLAQI SIKYQNQGKKDLLQASAEDDVKAIKDELDQTNNELHKEKIFHISQSEDKANILD KDEHFYLVFEECYFELANIVPLYNKIRNYITQKPYSDEKFKLNFENSTLANGWD KNKEPDNTAILFIKDDKYYLGVMNKKNNKIFDDKAIKENKGEGYKKIVYKLLP GANKMLPKVFFSAKSIKFYNPSEDILRIRNHSTHTKNGSPQKGYEKFEFNIEDC RKFIDFYKQSISKHPEWKDFGFRFSDTQRYNSIDEFYREVENQGYKLTFENISES YIDSVVNQGKLYLFQIYNKDFSAYSKGRPNEHTLYWKALFDERNLQDVVYKLN GEAELFYRKQSIPKKITHPAKEAIANKNKDNPKKESVFEYDLIKDKRFTEDKFF FHCPITINFKSSGANKFNDEINELLKEKANDVHILSIDRGERHLAYYTLVDGKG NIIKQDTFNIIGNDRMKTNYHDKLAAIEKDRDSARKDWKKINNIKEMKEGYLS QVVHEIAKLVIEYNAIVVFEDLNFGFKRGRFKVEKQVYQKLEKMLIEKLNYLV FKDNEFDKTGGVERAYQLTAPFETFKKAIGKQTGIIYYVPAGFTSKICPVTGFV NQLYPKYESVSKSQEFFSKFDKICYNEDKGYFEFSFDYKNFGDKAAKGKWTIA SFGSRLINFRNSDKNHNWDTREVYPTKELEKELKDYSIEYGHGECIKAAICGES DKKFFAKETSVENTILQMRNSKTGTELDYLISPVADVNGNFFDSRQAPKNMPQ DADANGAYHIGLKGEMLLGRIKNNQEGKKLNLVIKNEEYFEFVQNRNNQAAA <u>LDLQMASRRNLMIVDGTNLGFRFKHNNSKKPFASSYVSTIQSLAKSYSARTTIVLGD KGKSVFRLEHLPEYKGNRDEKYAQRTEEEKALDEQFFEYLKDAFELCKTTFPTFTIR GVEADDMAAYIVKLIGHLYDHVWLISTDGDWDTLLTDKVSRFSFTTRREYHLRDM YEHHNVDDVEQFISLKAIMGDLGDNIRGVEGIGAKRGYNIIREFGNVLDIIDQLPLPG KQKYIQNLNASEELLFRNLILVDLPTYCVDAIAAVGQDVLDKFTKDILEIAEQLQKR PAATKKAGQAKKKKHHHHH</u> | Bold indicates FnCpf1- Underlining indicates T5 |

TABLE 7-continued

| SEQ ID NO | Sequence | Description |
|---|---|---|
| 41 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGC ATGTCAATTTATCAAGAATTTGTTAA TAAATATAGTTTAAGTAAAAACTCTAAGATTTGAGTTAATCCCACAGGGTAAA ACACTTGAAAACATAAAAGCAAGAGGTTTGATTTTAGATGATGAGAAAGA GCTAAAGACTACAAAAAGGCTAAACAAATAATTGATAAATATCATCAGTTTT TTATAGAGGAGATATTAAGTTCGGTTTGTATTAGCGAAGATTTATTACAAAA CTATTCTGATGTTTATTTTAAACTTAAAAAGAGTGATGATGATAATCTACAA AAAGATTTTAAAAGTGCAAAAGATACGATAAAGAAACAAATATCTGAATAT ATAAAGGACTCAGAGAAATTTAAGAATTTGTTTAATCAAAACCTTATCGATG CTAAAAAAGGGCAAGAGTCAGATTTAATTCTATGGCTAAAGCAATCTAAGG ATAATGGTATAGAACTATTTAAAGCCAATAGTGATATCACAGATATAGATG AGGCGTTAGAAATAATCAAATCTTTTAAAGGTTGGACAACTTATTTTAAGG GTTTTCATGAAAATAGAAAAAATGTTTATAGTAGCAATGATATTCCTACATC TATTATTTATAGGATAGTAGATGATAATTTGCCTAAATTTCTAGAAAATAAA GCTAAGTATGAGAGTTTAAAAGACAAAGCTCCAGAAGCTATAAACTATGAA CAAATTAAAAAAGATTTGGCAGAAGAGCTAACCTTTGATATTGACTACAAA ACATCTGAAGTTAATCAAAGAGTTTTTTCACTTGATGAAGTTTTTGAGATAG CAAACTTTAATAATTATCTAAATCAAAGTGGTATTACTAAATTTAATACTAT TATTGGTGGTAAATTTGTAAATGGTGAAAATACAAAGAGAAAAGGTATAAA TGAATATATAAATCTATACTCACAGCAAATAAATGATAAAACACTCAAAAAA TATAAAATGAGTGTTTTATTTAAGCAAATTTTAAGTGATACAGAATCTAAAT CTTTTGTAATTGATAAGTTAGAAGATGATAGTGATGTAGTTACAACGATGC AAAGTTTTTATGAGCAAATAGCAGCTTTTAAACAGTAGAAGAAAAATCTA TTAAAGAAACACTATCTTTATTATTTGATGATTTAAAAGCTCAAAAACTTGA TTTGAGTAAAATTTATTTTAAAAATGATAAATCTCTTACTGATCTATCACAA CAAGTTTTTGATGATTATAGTGTTATTGGTACAGCGGTACTAGAATATATAA CTCAACAAATAGCACCTAAAAATCTTGATAACCCTAGTAAGAAAGAGCAAG AATTAATAGCCAAAAAAACTGAAAAAGCAAAATACTTATCTCTAGAAACTAT AAAGCTTGCCTTAGAAGAATTTAATAAGCATAGAGATATAGATAAACAGTG TAGGTTTGAAGAAATACTTGCAAACTTTGCGGCTATTCCGATGATATTTGAT GAAATAGCTCAAAACAAAGACAATTTGGCACAGATATCTATCAAATATCAA AATCAAGGTAAAAAAGACCTACTTCAAGCTAGTGCGGAAGATGATGTTAAA GCTATCAAGGATCTTTTAGATCAAACTAATAATCTCTTACATAAACTAAAAA TATTTCATATTAGTCAGTCAGAAGATAAGGCAAATATTTTAGACAAGGATG AGCATTTTTATCTAGTATTTGAGGAGTGCTACTTTGAGCTAGCGAATATAGT GCCTCTTTATAACAAAATTAGAAACTATATAACTCAAAAGCCATATAGTGAT GAGAAATTTAAGCTCAATTTTGAGAACTCGACTTTGGCTAATGGTTGGAT AAAAATAAAGAGCCTGACAATCGGCAATTTTATTTATCAAAGATGATAAAT ATTATCTGGGTGTGATGAATAAGAAAAATAACAAAATATTTGATGATAAAG CTATCAAAGAAAATAAAGGCGAGGGTTATAAAAAAATTGTTTATAAACTTTT ACCTGGCGCAAATAAAATGTTACCTAAGGTTTTCTTTTTCTGCTAAATCTATA AAATTTTATAATCCTAGTGAAGATATACTTAGAATAAGAAATCATTCCACAC ATACAAAAAATGGTAGTCCTCAAAAAGGATATGAAAAATTTGAGTTTAATA TTGAAGATTGCCGAAAATTTATAGATTTTTATAAACAGTCTATAAGTAAGCA TCCGGAGTGGAAAGATTTTGGATTTAGATTTTCTGATACTCAAAGATATAAT TCTATAGATGAATTTTATAGAGAAGTTGAAAATCAAGGCTACAAACTAACTT TTGAAAATATATCAGAGAGCTATATTGATAGCGTAGTAATCAGGGTAAAT TGTACCTATTCCAAATCTATAATAAAGATTTTTCAGCTTATAGCAAAGGGCG ACCAAATCTACATACTTTATATTGGAAAGCGCTGTTTGATGAGAGAAATCTT CAAGATGTGGTTTATAAGCTAAATGGTGAGGCAGAGCTTTTTATCGTAAA CAATCAATACCTAAAAAAATCACTCACCCAGCTAAAGAGGCAATAGCTAAT AAAAACAAAGATAATCCTAAAAAAGAGAGTGTTTTTGAATATGATTTAATCA AAGATAAACGCTTTACTGAAGATAAGTTTTTCTTTCACTGTCCTATTACAAT CAATTTTAAATCTAGTGGAGCTAATAAGTTTAATGATGAAATCAATTTATTG CTAAAAGAAAAAGCAAATGATGTTCATATATTAAGTATAGATAGAGGTGAA AGACATTTAGCTTACTATACTTTGGTAGATGGTAAAGGCAATATCATCAAA CAAGATACTTTCAACATCATTGGTAATGATAGAATGAAAACAAACTACCAT GATAAGCTTGCTGCAATAGAGAAAGATAGGGATTCAGCTAGGAAAGACTGG AAAAAGATAAATAACATCAAAGAGATGAAAGAGGGCTATCTATCTCAGGTA GTTCATGAAATAGCTAAGCTAGTTATAGAGTATAATGCTATTGTGGTTTTTG AGGATTTAAATTTTGGATTTAAAAGAGGGCGTTTCAAGGTAGAGAAGCAGG TCTATCAAAAGTTAGAAAAAATGCTAATTGAGAAACTAAACTATCTAGTTTT CAAAGATAATGAGTTTGATAAAACTGGGGGAGTGCTTAGAGCTTATCAGCT AACAGCACCTTTTGAGACTTTTAAAAAGATGGGTAAACAAACAGGTATTAT CTACTATGTACCAGCTGGTTTTACTTCAAAAATTTGTCCTGTAACTGGTTTT GTAAATCAGTTATATCCTAAGTATGAAAGTGTCAGCAAATCTCAAGAGTTC TTTAGTAAGTTTGACAAGATTTGTTATAACCTTGATAAGGGCTATTTTGAGT TTAGTTTTGATTATAAAAACTTTGGTGACAAGGCTGCCAAAGGCAAGTGGA CTATAGCTAGCTTTGGGAGTAGATTGATTAACTTTAGAAATTCAGATAAAA ATCATAATTGGGATACTCGAGAAGTTTATCCAACTAAAGAGTTGGAGAAAT TGCTAAAAGATTATTCTATCGAATATGGGCATGGCGAATGTATCAAAGCAG CTATTTGCGGTGAGAGCGACAAAAAGTTTTTTGCTAAGCTAACTAGTGTCC TAAATACTATCTTACAAATGCGTAACTCAAAAACAGGTACTGAGTTAGATTA TCTAATTTCACCAGTAGCAGATGTAAATGGCAATTTCTTTGATTCGCGACA GGCGCCAAAAAATATGCCTCAAGATGCTGATGCCAATGGTGCTTATCATAT | Bold indicates FnCpf1- Underlining indicates ambda |

TABLE 7-continued

| SEQ ID NO | Sequence | Description |
|---|---|---|
| | TGGGCTAAAAGGTCTGATGCTACTAGGTAGGATCAAAAATAATCAAGAGGG<br>CAAAAAACTCAATTTGGTTATCAAAAATGAAGAGTATTTTGAGTTCGTGCA<br>GAATAGGAATAACCAAGCGGCCGCACTCGACCTCGAG<u>ATGACACCGGACATTA</u><br><u>TCCTGCAGCGTACCGGGATCGATGTGAGAGCTGTCGAACAGGGGGATGATGCGT</u><br><u>GGCACAAATTACGGCTCGGCGTCATCACCGCTTCAGAAGTTCACAACGTGATAG</u><br><u>CAAAACCCCGCTCCGGAAAGAAGTGGCCTGACATGAAAATGTCCTACTTCCACA</u><br><u>CCCTGCTTGCTGAGGTTTGCACCGGTGTGGCTCCGGAAGTTAACGCTAAAGCAC</u><br><u>TGGCCTGGGGAAAACAGTACGAGAACGACGCCAGAACCCTGTTTGAATTCACTT</u><br><u>CCGGCGTGAATGTTACTGAATCCCCGATCATCTATCGCGACGAAAGTATGCGTA</u><br><u>CCGCCTGCTCTCCCGATGGTTTATGCAGTGACGGCAACGGCCTTGAACTGAAAT</u><br><u>GCCCGTTTACCTCCCGGGATTTCATGAAGTTCCGGCTCGGTGGTTTCGAGGCCAT</u><br><u>AAAGTCAGCTTACATGGCCCAGGTGCAGTACAGCATGTGGGTGACGCGAAAAA</u><br><u>ATGCCTGGTACTTTGCCAACTATGACCCGCGTATGAAGCGTGAAGGCCTGCATT</u><br><u>ATGTCGTGATTGAGCGGGATGAAAAGTACATGGCGAGTTTTGACGAGATCGTGC</u><br><u>CGGAGTTCATCGAAAAAATGGACGAGGCACTGGCTGAAATTGGTTTTGTATTTG</u><br><u>GGGAGCAATGGCGACTCGAGAAAAGGCCGGCGGCCACGAAAAAGGCCGGCCA</u><br><u>GGCAAAAAGAAAAAGCACCACCACCACCACTGA</u> | |
| 42 | MGSSHHHHHHSSGLVPRGSHMASMTGGQQMGRGSEFELRRQACGRMSIYQEFVN<br>KYSLSKTERFELIPQGKTLENIKARGLILDDEKRAKDYKKAKQIIDKYHQFFIEE<br>ILSSVCISEDLLQNYSDVYFKLKKSDDDNLQKDEKSAKDTIKKQISEYIKDSEKE<br>KNLENQNLIDAKKGQESDLIEWLKQSKDNGIELFKANSDITDIDEALEIIKSFKG<br>WTTYFKGEHENRKNVYSSNDIPTSIIYRIVDDNLPKFLENKAKYESLKDKAPEAI<br>NYEQIKKDLAEELTEDIDYKTSEVNQRVESLDEVFEIANENNYLNQSGITKENTII<br>GGKEVNGENTKRKGINEYINLYSQQINDKTEKKYKMSVLEKQILSDTESKSFVI<br>DKLEDDSDVVTTMQSFYEQIAAFKTVEEKSIKETLSELFDDLKAQKLDLSKIYF<br>KNDKSLTDESQQVFDDYSVIGTAVLEYITQQIAPKNEDNPSKKEQELIAKKTEK<br>AKYLSLETIKLALEEENKHRDIDKQCRFEEILANFAAIPMIFDEIAQNKDNLAQI<br>SIKYQNQGKKDLLQASAEDDVKAIKDELDQTNNELHKEKIFHISQSEDKANILD<br>KDEHFYLVFEECYFELANIVPLYNKIRNYITQKPYSDEKFKLNFENSTLANGWD<br>KNKEPDNTAILFIKDDKYYLGVMNKKNNKIFDDKAIKENKGEGYKKIVYKLLP<br>GANKMLPKVFFSAKSIKEYNPSEDILRIRNHSTHTKNGSPQKGYEKFEENIEDC<br>RKFIDEYKQSISKHPEWKDEGFRESDTQRYNSIDEFYREVENQGYKLTFENISES<br>YIDSVVNQGKLYLFQIYNKDFSAYSKGRPNEHTLYWKALFDERNLQDVVYKLN<br>GEAELFYRKQSIPKKITHPAKEAIANKNKDNPKKESVFEYDLIKDKRFTEDKFF<br>FHCPITINEKSSGANKENDEINELLKEKANDVHILSIDRGERHLAYYTLVDGKG<br>NIIKQDTENIIGNDRMKTNYHDKLAAIEKDRDSARKDWKKINNIKEMKEGYLS<br>QVVHEIAKLVIEYNAIVVFEDLNEGFKRGREKVEKQVYQKLEKMLIEKLNYLV<br>FKDNEFDKTGGVERAYQLTAPFETFKKAIGKQTGIIYYVPAGFTSKICPVTGEV<br>NQLYPKYESVSKSQEFFSKEDKICYNEDKGYFEFSFDYKNEGDKAAKGKWTIA<br>SEGSRLINFRNSDKNHNWDTREVYPTKELEKELKDYSIEYGHGECIKAAICGES<br>DKKFFAKETSVENTILQMRNSKTGTELDYLISPVADVNGNFEDSRQAPKNMPQ<br>DADANGAYHIGLKGEMLLGRIKNNQEGKKLNLVIKNEEYFEFVQNRNNQAAA<br><u>LDLEMTPDIILQRTGIDVRAVEQGDDAWHKLRLGVITASEVHNVIAKPRSGKKWPD</u><br><u>MKMSYFHTLLAEVCTGVAPEVNAKALAWGKQYENDARTLFEFTSGVNVTESPITYR</u><br><u>DESMRTACSPDGLCSDGNGLELKCPFTSRDFMKFRLGGFEAIKSAYMAQVQYSMW</u><br><u>VIRKNAWYFANYDPRMKREGLHYVVIERDEKYMASFDEIVPEFIEKMDEALAEIGF</u><br><u>VFGEQWRLEKRPAATKKAGQAKKKKHHHHH</u> | Bold indicates FnCpf1-<br>Underlining indicates lambda |
| 43 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCCGAATTC<br>GAGCTCCGTCGACAAGCTTGCGGCCGCATGTCAATTTATCAAGAATTTGTTAA<br>TAAATATAGTTTAAGTAAAACTCTAAGATTTGAGTTAATCCCACAGGGTAAA<br>ACACTTGAAAACATAAAAGCAAGAGGTTTGATTTTAGATGATGAGAAAGA<br>GCTAAAGACTACAAAAAGGCTAAACAAATAATTGATAAATATCATCAGTTTT<br>TTATAGAGGAGATATAAGTTCGTTTGTATTAGCGAAGATTATTACAAAA<br>CTATTCTGATGTTTATTTTAAACTTAAAAGAGTGATGATGATAATCTACAA<br>AAAGATTTTAAAAGTGCAAAAGATACGATAAAGAAACAAATATCTGAATAT<br>ATAAAGGACTCAGAGAAATTTAAGAATTTGTTTAATCAAAACCTTATCGATG<br>CTAAAAAGGGCAAGAGTCAGATTTAATTCTATGGCTAAAGCAATCTAAGG<br>ATAATGGTATAGAACTATTTAAAGCCAATAGTGATATCACAGATATAGATG<br>AGGCGTTAGAAATAATCAAATCTTTTAAAGGTTGGACAACTTATTTTAAGG<br>GTTTTCATGAAAATAGAAAAAAATGTTTATAGTAGCAATGATATTCCTACATC<br>TATTATTTATAGGATAGTAGATGATAATTTGCCTAAATTTCTAGAAAATAAA<br>GCTAAGTATGAGAGTTTAAAAGACAAAGCTCCAGAAGCTATAAACTATGAA<br>CAAATTAAAAAAGATTTGGCAGAAGAGCTAACCTTTGATATTGACTACAAA<br>ACATCTGAAGTTAATCAAAGAGTTTTTTCACTTGATGAAGTTTTTGAGATAG<br>CAAACTTTAATAATTATCTAAATCAAAGTGGTATTACTAAATTTAATACTAT<br>TATTGGTGGTAAATTTGTAAATGGTGAAATACAAAGAGAAAGGTATAAA<br>TGAATATATAAATCTATACTCACAGCAAATAAATGATAAAACACTCAAAAAA<br>TATAAAGTAGTGTTTTATTTAAGCAAATTTTAAGTGATACAGAATTTAAA<br>CTTTTGTAATTGATAAGTTAGAAGATGATAGTGATGTAGTTACAACGATGC<br>AAAGTTTTTATGAGCAAATAGCAGCTTTTAAAACAGTAGAAGAAAATCTA<br>TTAAAGAAACACTATCTTTATTATTTGATGATTTAAAAGCTCAAAAACTTGA<br>TTTGAGTAAAATTTATTTTAAAAATGATAAATCTCTTACTGATCTATCACAA<br>CAAGTTTTTGATGATTATAGTGTTATTGGTACAGCGGTACTAGAATATATAA | Bold indicates FnCpf1-<br>Underlining indicates mungbean |

TABLE 7-continued

| SEQ ID NO | Sequence | Description |
|---|---|---|
| | CTCAACAAATAGCACCTAAAAATCTTGATAACCCTAGTAAGAAAGAGCAAG<br>AATTAATAGCCAAAAAAACTGAAAAAGCAAATACTTATCTCTAGAAACTAT<br>AAAGCTTGCCTTAGAAGAATTTAATAAGCATAGAGATATAGATAAACAGTG<br>TAGGTTTGAAGAAATACTTGCAAACTTTGCGGCTATTCCGATGATATTTGAT<br>GAAATAGCTCAAAACAAAGACAATTTGGCACAGATATCTATCAAATATCAA<br>AATCAAGGTAAAAAAGACCTACTTCAAGCTAGTGCGGAAGATGATGTTAAA<br>GCTATCAAGGATCTTTTAGATCAAACTAATAATCTCTTACATAAACTAAAAA<br>TATTTCATATTAGTCAGTCAGAAGATAAGGCAAATATTTTAGACAAGGATG<br>AGCATTTTTATCTAGTATTTGAGGAGTGCTACTTTGAGCTAGCGAATATAGT<br>GCCTCTTTATAACAAAATTAGAAACTATATAACTCAAAAGCCATATAGTGAT<br>GAGAAATTTAAGCTCAATTTTGAGAACTCGACTTTGGCTAATGGTTGGGAT<br>AAAAATAAAGAGCCTGACAATACGGCAATTTTATTTATCAAAGATGATAAAT<br>ATTATCTGGGTGTGATGAATAAGAAAAATAACAAAATATTTGATGATAAAG<br>CTATCAAAGAAAATAAAGGCGAGGGTTATAAAAAAATTGTTTATAAACTTTT<br>ACCTGGCGCAAATAAAATGTTACCTAAGGTTTTCTTTTCTGCTAAATCTATA<br>AAATTTTATAATCCTAGTGAAGATATACTTAGAATAAGAAATCATTCCACAC<br>ATACAAAAAATGGTAGTCCTCAAAAAGGATATGAAAAATTTGAGTTTAATA<br>TTGAAGATTGCCGAAAATTTATAGATTTTTATAAACAGTCTATAAGTAAGCA<br>TCCGGAGTGGAAAGATTTTGGATTTAGATTTTCTGATACTCAAAGATATAAT<br>TCTATAGATGAATTTTATAGAGAAGTTGAAAATCAAGGCTACAAACTAACTT<br>TTGAAAATATATCAGAGAGCTATATTGATAGCGTAGTTAATCAGGGTAAAT<br>TGTACCTATTCCAAATCTATAATAAAGATTTTTCAGCTTATAGCAAAGGGCG<br>ACCAAATCTACATACTTTATATTGGAAAGCGCTGTTTGATGAGAGAAATCTT<br>CAAGATGTGGTTTATAAGCTAAATGGTGAGGCAGAGCTTTTTTATCGTAAA<br>CAATCAATACCTAAAAAAATCACTCACCCAGCTAAAGAGGCAATAGCTAAT<br>AAAAACAAAGATAATCCTAAAAAAGAGAGTGTTTTTGAATATGATTTAATCA<br>AAGATAAACGCTTTACTGAAGATAAGTTTTTCTTTCACTGTCCTATTACAAT<br>CAATTTTAAATCTAGTGGAGCTAATAAGTTTAATGATGAAATCAATTTATTG<br>CTAAAAGAAAAAGCAAATGATGTTCATATATTAAGTATAGATAGAGGTGAA<br>AGACATTTAGCTTACTATACTTTGGTAGATGGTAAAGGCAATATCATCAAA<br>CAAGATACTTTCAACATCATTGGTAATGATAGAATGAAAACAAACTACCAT<br>GATAAGCTTGCTGCAATAGAGAAAGATAGGGATTCAGCTAGGAAAGACTGG<br>AAAAAGATAAATAACATCAAAGAGATGAAAGAGGGCTATCTATCTCAGGTA<br>GTTCATGAAATAGCTAAGCTAGTTATAGAGTATAATGCTATTGTGGTTTTG<br>AGGATTTAAATTTTGGATTTAAAAGAGGGCGTTTCAAGGTAGAGAAGCAGG<br>TCTATCAAAAGTTAGAAAAAATGCTAATTGAGAAACTAAACTATCTAGTTTT<br>CAAAGATAATGAGTTTGATAAAACTGGGGAGTGCTTAGAGCTTATCAGCT<br>AACAGCACCTTTTGAGACTTTTAAAAAGATGGGTAAACAAACAGGTATTAT<br>CTACTATGTACCAGCTGGTTTTACTTCAAAAATTTGTCCTGTAACTGGTTTT<br>GTAAATCAGTTATATCCTAAGTATGAAAGTGTCAGCAAATCTCAAGAGTTC<br>TTTAGTAAGTTTGACAAGATTTGTTATAACCTTGATAAGGGCTATTTTGAGT<br>TTAGTTTTGATTATAAAAACTTTGGTGACAAGGCTGCCAAAGGCAAGTGGA<br>CTATAGCTAGCTTTGGGAGTAGATTGATTAACTTTAGAAATTCAGATAAAA<br>ATCATAATTGGGATACTCGAGAAGTTTATCCAACTAAAGAGTTGGAGAAAT<br>TGCTAAAAGATTATTCTATCGAATATGGGCATGGCGAATGTATCAAAGCAG<br>CTATTTGCGGTGAGAGCGACAAAAAGTTTTTTGCTAAGCTAACTAGTGTCC<br>TAAATACTATCTTACAAATGCGTAACTCAAAAACAGGTACTGAGTTAGATTA<br>TCTAATTTCACCAGTAGCAGATGTAAATGGCAATTTCTTTGATTCGCGACA<br>GGCGCCAAAAAATATGCCTCAAGATGCTGATGCCAATGGTGCTTATCATAT<br>TGGGCTAAAAGGTCTGATGCTACTAGGTAGGATCAAAAATAATCAAGAGGG<br>CAAAAAACTCAATTTGGTTATCAAAAATGAAGAGTATTTTGAGTTCGTGCA<br>GAATAGGAATAACCA<u>AGCGGCCGCACTCGACCTGCAGATGCAAACGTTACAGA<br>TGAGTCTGTTGACACAACCTTACGTTCAGCCTCGTTTCCCTTGCAAGCGTTACCC<br>GACCTTCTCCGCATCCTGCAGAACTCAAAAGACAGCGATCACGAAAACAGAGA<br>AGGTGTTTTTCAGTGAGTCATTTGATCAAACACGTTGCACGCAGCCTCTCTCGGA<br>AAAGAAGAAGAGGGTGTTCTTTTTGGACGTTAACCCGCTCTGTTACGAAGGAAG<br>CAAGCCCAGCTTGCGCTCCTTCGGGCGGTGGCTCTCTCTGTTTCTCCATCAAGTC<br>AGCCTCACTGACCCCGTCATTGCTGTTATTGATGGAGAAGGAGGCAGCGAGCAT<br>CGCAGAAAGTTGCTACCTTCATATAAAGCACATAGGAAAAAGTTCATGAGACAC<br>ATGTCAAGTGGCCATGTTGGGAGGTCTCATCAAGTTATAAATGATGTTCTTGGA<br>AAATGCAACGTGCCAGTTATAAAGGTTGCTGGTCATGAAGCTGATGATGTTGTA<br>GCTACTCTAGCTGGACAAGTTGTCAATAAAGGGTTTCGAGTGGTCATTGGCTCC<br>CCTGATAAGGATTTTAAGCAGCTTATATCTGAAGATGTGCAAATAGTTATGCCTT<br>TGCCAGAGTTACAAAGGTGGTCCTTCTACACTCTGAGGCACTACAGGGATCAGT<br>ATAATTGTGATCCAGAATCTGATCTGAGCTTTAGATGCATTGTAGGTGATGAAG<br>TAGACGGCGTTCCTGGTATCCAGCATTTGGTCCCTAGTTTTGGTCGGAAGACTGC<br>TATGAAACTTATTAAAAAACATGGTTCTTGGAAACTTTATTAAATGCGGCTGC<br>AATAAGGACTGTAGGCAGACCATATGCACAGGATGCCCTCAAAAACCATGCTG<br>ATTACCTTCGGAGAAACTATGAAGTTCTTGCCTTGAAAAGGGATGTAAATATCC<br>AACTTTATGATGAGTGGTTGGTTAAGAGAGACAATCACAATGATAAAACTGCAC<br>TATCTTCCTTCTTCAAATATTTGGGAGAAAGTAAGGAGCTCAGTTACAATGGCA<br>GACCTATCTCTTACAATGGTCTGCAGAAAAGGCCGGCGGCCACGAAAAAGGCC<br>GGCCAGGCAAAAAAGAAAAAGCACCACCACCACCACTGA</u> | |

TABLE 7-continued

| SEQ ID NO | Sequence | Description |
|---|---|---|
| 44 | MGSSHHHHHHSSGLVPRGSHMASMTGGQQMGRGSEFELRRQACGRMSIYQEFVN KYSLSKTLRFELIPQGKTLENIKARGLILDDEKRAKDYKKAKQIIDKYHQFFIEE ILSSVCISEDLLQNYSDVYFKLKKSDDDNLQKDFKSAKDTIKKQISEYIKDSEKF KNLFNQNLIDAKKGQESDLILWLKQSKDNGIELFKANSDITDIDEALEIIKSFKG WTTYFKGFHENRKNVYSSNDIPTSHYRIVDDNLPKFLENKAKYESLKDKAPEAI NYEQIKKDLAEELTFDIDYKTSEVNQRVFSLDEVFEIANFNNYLNQSGITKFNTII GGKFVNGENTKRKGINEYINLYSQQINDKTLKKYKMSVLFKQILSDTESKSFVI DKLEDDSDVVTTMQSFYEQIAAFKTVEEKSIKETLSLLFDDLKAQKLDLSKIYF KNDKSLTDLSQQVFDDYSVIGTAVLEYITQQIAPKNLDNPSKKEQELIAKKTEK AKYLSLETIKLALEEFNKHRDIDKQCRFEEILANFAAIPMIFDEIAQNKDNLAQI SIKYQNQGKKDLLQASAEDDVKAIKDLLDQTNNLLHKLKIFHISQSEDKANILD KDEHFYLVFEECYFELANIVPLYNKIRNYITQKPYSDEKFKLNFENSTLANGWD KNKEPDNTAILFIKDDKYYLGVMNKKNNKIFDDKAIKENKGEGYKKIVYKLLP GANKMLPKVFFSAKSIKFYNPSEDILRIRNHSTHTKNGSPQKGYEKFEFNIEDC RKFIDFYKQSISKHPEWKDFGFRFSDTQRYNSIDEFYREVENQGYKLTFENISES YIDSVVNQGKLYLFQIYNKDFSAYSKGRPNLHTLYWKALFDERNLQDVVYKLN GEAELFYRKQSIPKKITHPAKEAIANKNKDNPKKESVFEYDLIKDKRFTEDKFF FHCPITINFKSSGANKFNDEINLLLKEKANDVHILSIDRGERHLAYYTLVDGKG NIIKQDTFNIIGNDRMKTNYHDKLAAIEKDRDSARKDWKKINNIKEMKEGYLS QVVHEIAKLVIEYNAIVVFEDLNFGFKRGRFKVEKQVYQKLEKMLIEKLNYLV FKDNEFDKTGGVLRAYQLTAPFETFKKMGKQTGIIYYVPAGFTSKICPVTGFV NQLYPKYESVSKSQEFFSKFDKICYNLDKGYFEFSFDYKNFGDKAAKGKWTIA SFGSRLINFRNSDKNHNWDTREVYPTKELEKLLKDYSIEYGHGECIKAAICGES DKKFFAKLTSVLNTILQMRNSKTGTELDYLISPVADVNGNFFDSRQAPKNMPQ DADANGAYHIGLKGLMLLGRIKNNQEGKKLNLVIKNEEYFEFVQNRNNQAAA LDLQMQTLQMSLLTQPYVQPRFPCKRYPTFSASCRTQKTAITKTEKVFFSESFDQTR CTQPLSEKKKRVFFLDVNPLCYEGSKPSLRSFGRWLSLFLHQVSLTDPVIAVIDGEG GSEHRRKLLPSYKAHRKKFMRHMSSGHVGRSHQVINDVLGKCNVPVIKVAGHEAD DVVATLAGQVVNKGFRVVIGSPDKDFKQLISEDVQIVMPLPELQRWSFYTLRHYRD QYNCDPESDLSFRCIVGDEVDGVPGIQHLVPSFGRKTAMKLIKKHGSLETLLNAAAI RTVGRPYAQDALKNHADYLRRNYEVLALKRDVNIQLYDEWLVKRDNHNDKTALS SFFKYLGESKELSYNGRPISYNGLQKRPAATKKAGQAKKKKHHHHH | Bold indicates FnCpf1-Underlining indicates mungbean |
| 45 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCCGAATTC GAGCTCCGTCGACAAGCTTGCGGCCGCATGTCAATTTATCAAGAATTTGTTAA TAAATATAGTTTAAGTAAAACTCTAAGATTTGAGTTAATCCACAGGGTAAA ACACTTGAAAACATAAAAGCAAGAGGTTTGATTTTAGATGATGAGAAAGA GCTAAAGACTACAAAAGGCTAAACAAATAATTGATAAATATCATCAGTTTT TTATAGAGAGATATTAAGTTCGGTTTGTATTAGCGAAGATTTATTACAAAA CTATTCTGATGTTTATTTTAAACTTAAAAAGAGTGATGATGATAATCTACA AAAGATTTTAAAGTGCAAAAGATACGATAAAGAAACAAATATCTGAATAT ATAAAGGACTCAGAGAAATTTAAGAATTTGTTTAATCAAAACCTTATCGATG CTAAAAAAGGGCAAGAGTCAGATTTAATTCTATGGCTAAAGCAATCTAAGG ATAATGGTATAGAACTATTTAAAGCCAATAGTGATATCACAGATATAGATG AGGCGTTAGAAATAATCAAATCTTTTAAAGGTTGGACAACTTATTTTAAGG GTTTTCATGAAAATAGAAAAAATGTTTATAGTAGCAATGATATTCCTACATC TATTATTTATAGGATAGTAGATGATAATTTGCCTAAATTTCTAGAAAATAAA GCTAAGTATGAGAGTTTAAAAGACAAAGCTCCAGAAGCTATAAACTATGAA CAAATTAAAAAGGATTTGGCAGAAGAGCTAACCTTTGATATTGACTACAAA ACATCTGAAGTTAATCAAGAGTTTTTTCACTTGATGAAGTTTTTGAGATAG CAAACTTTAATAATTATCTAAATCAAAGTGGTATTACTAAATTTAATACTAT TATTGGTGGTAAATTTGTAAATGGTGAAAATACAAAGAGAAAAGGTATAA TGAATATATAAATCTATACTCACAGCAAATAAATGATAAAACACTCAAAAAA TATAAAATGAGTGTTTTATTTAAGCAAATTTTAAGTGATACAGAATCTAAAT CTTTTGTAATTGATAAGTTAGAAGATGATAGTGATGTAGTTACAACGATGC AAAGTTTTTATGAGCAAATAGCAGCTTTTAAAACAGTAGAAGAAAAATCTA TTAAAGAAACACTATCTTTATTATTTGATGATTTAAAAGCTCAAAAACTTGA TTTGAGTAAAATTTATTTTAAAAATGATAAATCTCTTACTGATCTATCACAA CAAGTTTTTTGATGATTATAGTGTTATTGGTACAGCGGTACTAGAATATATAA CTCAACAAATAGCACCTAAAAATCTTGATAACCCTAGTAAGAAAGAGCAAG AATTAATAGCCAAAAAAACTGAAAAAGCAAAATACTTATCTCTAGAACTAT AAAGCTTGCCTTAGAAGAATTTAATAAGCATAGAGATATAGATAAACAGTG TAGGTTTGAAGAAATACTTGCAAACTTTGCGGCTATTCCGATGATATTTGAT GAAATAGCTCAAAACAAAGACAATTTGGCACAGATATCTATCAAATATCAA AATCAAGGTAAAAAAGACCTACTTCAAGCTAGTGCGGAAGATGATGTTAAA GCTATCAAGGATCTTTTAGATCAAACTAATAATCTCTTACATAAACTAAAAA TATTTCATATTAGTCAGTCAGAAGATAAGGCAAATATTTTAGACAAGGATG AGCATTTTTATCTAGTATTTGAGGAGTGCTACTTTGAGCTAGCGAATATAGT GCCTTTATAACAAAATAGAAACTATATAACTCAAAAGCCATATAGTGAT GAGAAATTTAAGCTCAATTTTGAGAACTCGACTTTGGCTAATGGTTGGGAT AAAAATAAGAGCCTGACAATACGGCAATTTATTTATCAAAGATGATAAAT ATTATCTGGGTGTGATGAATAAGAAAAATAACAAAATATTTGATGATAAAG CTATCAAAGAAAATAAAGGCGAGGGTTATAAAAAAATTGTTTATAAACTTTT ACCTGGCGCAAATAAAATGTTACCTAAGGTTTTCTTTTCTGCTAAATCTATA | Bold indicates FnCpf1-Underlining indicates GFP |

TABLE 7-continued

| SEQ ID NO | Sequence | Description |
|---|---|---|
| | AAATTTTATAATCCTAGTGAAGATATACTTAGAATAAGAAATCATTCCACAC<br>ATACAAAAAATGGTAGTCCTCAAAAAGGATATGAAAAATTTGAGTTTAATA<br>TTGAAGATTGCCGAAAATTTATAGATTTTTATAAACAGTCTATAAGTAAGCA<br>TCCGGAGTGGAAAGATTTTGGATTTAGATTTTCTGATACTCAAAGATATAAT<br>TCTATAGATGAATTTTATAGAGAAGTTGAAAATCAAGGCTACAAACTAACTT<br>TTGAAAATATATCAGAGAGCTATATTGATAGCGTAGTAATCAGGGTAAAT<br>TGTACCTATTCCAAATCTATAATAAAGATTTTTCAGCTTATAGCAAAGGGCG<br>ACCAAATCTACATACTTTATATTGGAAAGCGCTGTTTGATGAGAGAAATCTT<br>CAAGATGTGGTTTATAAGCTAAATGGTGAGGCAGAGCTTTTTTATCGTAAA<br>CAATCAATACCTAAAAAAATCACTCACCCAGCTAAAGAGGCAATAGCTAAT<br>AAAAACAAAGATAATCCTAAAAAGAGAGTGTTTTGAATATGATTTAATCA<br>AAGATAAACGCTTTACTGAAGATAAGTTTTTCTTTCACTGTCCTATTACAAT<br>CAATTTTAAATCTAGTGGAGCTAATAAGTTTAATGATGAAATCAATTTATTG<br>CTAAAAGAAAAAGCAAATGATGTTCATATATTAAGTATAGATAGAGGTGAA<br>AGACATTTAGCTTACTATACTTTGGTAGATGGTAAAGGCAATATCATCAAA<br>CAAGATACTTTCAACATCATTGGTAATGATAGAATGAAAACAAACTACCAT<br>GATAAGCTTGCTGCAATAGAGAAAGATAGGGATTCAGCTAGGAAAGACTGG<br>AAAAAGATAAATAACATCAAAGAGATGAAAGAGGGCTATCTATCTCAGGTA<br>GTTCATGAAATAGCTAAGCTAGTTATAGAGTATAATGCTATTGTGGTTTTTG<br>AGGATTTAAATTTTGGATTTAAAAGAGGGCGTTTCAAGGTAGAGAAGCAGG<br>TCTATCAAAAGTTAGAAAAAATGCTAATTGAGAAACTAAACTATCTAGTTTT<br>CAAAGATAATGAGTTTGATAAAACTGGGGGAGTGCTTAGAGCTTATCAGCT<br>AACAGCACCTTTTGAGACTTTTAAAAAGATGGGTAAACAAACAGGTATTAT<br>CTACTATGTACCAGCTGGTTTTACTTCAAAAATTTGTCCTGTAACTGGTTTT<br>GTAAATCAGTTATATCCTAAGTATGAAAGTGTCAGCAAATCTCAAGAGTTC<br>TTTAGTAAGTTTGACAAGATTTGTTATAACCTTGATAAGGGCTATTTTGAGT<br>TTAGTTTTGATTATAAAAACTTTGGTGACAAGGCTGCCAAAGGCAAGTGGA<br>CTATAGCTAGCTTTGGGAGTAGATTGATTAACTTTAGAAATTCAGATAAAA<br>ATCATAATTGGGATACTCGAGAAGTTTATCCAACTAAAGAGTTGGAGAAAT<br>TGCTAAAAGATTATTCTATCGAATATGGGCATGGCGAATGTATCAAAGCAG<br>CTATTTGCGGTGAGAGCGACAAAAAGTTTTTTGCTAAGCTAACTAGTGTCC<br>TAAATACTATCTTACAAATGCGTAACTCAAAAACAGGTACTGAGTTAGATTA<br>TCTAATTTCACCAGTAGCAGATGTAAATGGCAATTTCTTTGATTCGCGACA<br>GGCGCCAAAAAATATGCCTCAAGATGCTGATGCCAATGGTGCTTATCATAT<br>TGGGCTAAAAGGTCTGATGCTACTAGGTAGGATCAAAAATAATCAAGAGGG<br>CAAAAAACTCAATTTGGTTATCAAAAATGAAGAGTATTTTGAGTTCGTGCA<br>GAATAGGAATAACCAAGCGGCCGCACTCGACCTCGAG<u>ATGAGTAAAGGAGAA<br>GAACTTTTCACTGGAGTTGTCCCAATTCTTGTTGAATTAGATGGTGATGTTAATG<br>GGCACAAATTTTCTGTCAGTGGAGAGGGTGAAGGTGATGCAACATACGGAAAA<br>CTTACCCTTAAATTTATTTGCACTACTGGAAAACTACCTGTTCCATGGCCAACAC<br>TTGTCACTACTTTCTCTTATGGTGTTCAATGCTTTCAAGATACCCAGATCATAT<br>GAAGCGGCACGACTTCTTCAAGAGCGCCATGCCTGAGGGATACGTGCAGGAGA<br>GGACCATCTCTTTCAAGGACGACGGGAACTACAAGACACGTGCTGAAGTCAAGT<br>TTGAGGGAGACACCCTCGTCAACAGGATCGAGCTTAAGGGAATCGATTTCAAGG<br>AGGACGGAAACATCCTCGGCCACAAGTTGGAATACAACTACAACTCCCACAAC<br>GTATACATCACGGCAGACAAACAAAAGAATGGAATCAAAGCTAACTTCAAAT<br>TAGACACAACATTGAAGATGGAAGCGTTCAACTAGCAGACCATTATCAACAAA<br>ATACTCCAATTGGCGATGGCCCTGTCCTTTTACCAGACAACCATTACCTGTCCAC<br>ACAATCTGCCCTTTCGAAAGATCCCAACGAAAAGAGAGACCACATGGTCCTTCT<br>TGAGTTTGTAACAGCTGCTGGGATTACACATGGCATGGATGAACTATACAAACT<br>CGAGAAAAGGCCGGCGGCCACGAAAAAGGCCGGCCAGGCAAAAAGAAAAAG</u><br>CACCACCACCACCACTGA | |
| 46 | MGSSHHHHHHSSGLVPRGSHMASMTGGQQMGRGSEFELRRQACGR**MSIYQEFVN<br>KYSLSKTLRFELIPQGKTLENIKARGLILDDEKRAKDYKKAKQIIDKYHQFFIEE<br>ILSSVCISEDLLQNYSDVYFKLKKSDDDNLQKDFKSAKDTIKKQISEYIKDSEKF<br>KNLFNQNLIDAKKGQESDLILWLKQSKDNGIELFKANSDITDIDEALEIIKSFKG<br>WTTYFKGFHENRKNVYSSNDIPTSHYRIVDDNLPKFLENKAKYESLKDKAPEAI<br>NYEQIKKDLAEELTFDIDYKTSEVNQRVFSLDEVFEIANFNNYLNQSGITKFNTII<br>GGKFVNGENTKRKGINEYINLYSQQINDKTLKKYKMSVLFKQILSDTESKSFVI<br>DKLEDDSDVVTTMQSFYEQIAAFKTVEEKSIKETLSLLFDDLKAQKLDLSKIYF<br>KNDKSLTDLSQQVFDDYSVIGTAVLEYITQQIAPKNLDNPSKKEQELIAKKTEK<br>AKYLSLETIKLALEEFNKHRDIDKQCRFEEILANFAAIPMIFDEIAQNKDNLAQI<br>SIKYQNQGKKDLLQASAEDDVKAIKDLLDQTNNLLHKLKIFHISQSEDKANILD<br>KDEHFYLVFEECYFELANIVPLYNKIRNYITQKPYSDEKFKLNFENSTLANGWD<br>KNKEPDNTAILFIKDDKYYLGVMNKKNNKIFDDKAIKENKGEGYKKIVYKLLP<br>GANKMLPKVFFSAKSIKFYNPSEDILRIRNHSTHTKNGSPQKGYEKFEFNIEDC<br>RKFIDFYKQSISKHPEWKDFGRFSDTQRYNSIDEFYREVENQGYKLTFENISES<br>YIDSVVNQGKLYLFQIYNKDFSAYSKGRPNLHTLYWKALFDERNLQDVVYKLN<br>GEAELFYRQSIPKKITHPAKEAIANKNKDNPKKESVFEYDLIKDKRFTEDKFF<br>FHCPITINFKSSGANKFNDEINLLLKEKANDVHILSIDRGERHLAYYTLVDGKG<br>NIIKQDTFNIIGNDRMKTNYHDKLAAIEKDRDSARKDWKKINNIKEMKEGYLS<br>QVVHEIAKLVIEYNAIVVFEDLNEGFKRGREKVEKQVYQKLEKMLIEKLNYLV<br>FKDNEFDKTGGVLRAYQLTAPFETFKKMGKQTGIIYYVPAGFTSKICPVTGEV<br>NQLYPKYESVSKSQEFFSKEDKICYNLDKGYFEFSFDYKNEGDKAAKGKWTIA<br>SEGSRLINFRNSDKNHNWDTREVYPTKELEKLLKDYSIEYGHGECIKAAICGES | Bold indicates FnCpf1—Underlining indicates GFP |

TABLE 7-continued

| SEQ ID NO | Sequence | Description |
|---|---|---|
| | DKKFFAKLTSVLNTILQMRNSKTGTELDYLISPVADVNGNFEDSRQAPKNMPQ DADANGAYHIGLKGLMLLGRIKNNQEGKKLNLVIKNEEYFEFVQNRNNQAAA LDLEMSKGEELFTGVVPILVELDGDVNGHKFSVSGEGEGDATYGKLTLKFICTTGK LPVPWPTLVTTFSYGVQCFSRYPDHMKRHDFFKSAMPEGYVQERTISFKDDGNYKT RAEVKFEGDTLVNRIELKGIDFKEDGNILGHKLEYNYNSHNVYITADKQKNGIKAN FKIRHNIEDGSVQLADHYQQNTPIGDGPVLLPDNHYLSTQSALSKDPNEKRDHMVL LEFVTAAGITHGMDELYKLEKRPAATKKAGQAKKKKHHHHHH | |
| 47 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCC<u>GTGAA</u> <u>ACAACAGATACAACTTCGTCGCCGTGAAGTCGATGAAACGGCAGACTTGCCCGC TGAATTGCCTCCCTTGCTGCGCCGTTTATACGCCAGCCGGGGCGTGCGCAGTGC GCAAGAACTGGAACGCAGTGTTAAAGGTATGTTGCCCTGGCAGCAACTGAGCG GCGTCGAAAAGGCCGTTGAGATCCTTTACAACGCTTTTCGCGAAGGAACGCGGA TTATTGTGGTCGGCGATTTTGACGCCGACGGCGCGACCAGCACGGCTCTAAGCG TGCTGGCGATGCGCTCGCTTGGTTGCAGCAATATCGACTATCTGGTACCAAACC GTTTCGAAGACGGTTACGGCTTAAGCCCGGAAGTAGTCGATCAGGCCCATGCCC GTGGCGCGCAGTTAATTGTCACGGTGGATAACGGTATTTCCTCCCATGCGGGCG TTGAACACGCTCGCTCGTTGGGCATTCCGGTTATTGTTACCGATCACCATTTGCC GGGCGAAACATTACCCGCAGCGGAAGCGATCATTAACCCTAACTTGCGCGACTG TAATTTCCCGTCGAAATCACTGGCAGGCGTGGGTGTGGCGTTTTATCTGATGCTG GCGCTGCGCACCTTTTTGCGCGATCAGGGCTGGTTTGATGAGCGTGGCATCGCA ATTCCTAACCTGGCAGAACTGCTGGATCTGGTCGCGCTGGGAACAGTGGCGGAC GTCGTGCCGCTGGACGCTAATAATCGCATTCTGACCTGGCAGGGGATGAGTCGC ATCCGTGCCGGAAAGTGCCGTCCAGGGATTAAAGCGCTGCTGGAAGTGGCAAA CCGTGATGCACAAAAACTCGCCGCCAGCGATTTAGGTTTTGCGCTGGGGCCACG TCTCAATGCTGCCGGACGACTGGACGATATGTCCGTCGGTGTGGCGCTCTTGCT GTGCGACAACATCGGCGAAGCGCGCGTGCTGGCAAATGAACTCGATGCGCTAA ACCAGACGCGAAAAGAGATCGAACAAGGAATGCAAGTTGAAGCCCTGACCCTG TGCGAGAAACTGGAGCGAAGTCGCGACACGCTACCCGGCGGGCTGGCAATGTA TCACCCCGAATGGCATCAGGGCGTTGTCGGTATTCTGGCTTCGCGCATCAAAGA GCGTTTTCACCGTCCGGTTATCGCCTTTGCGCCAGCAGGTGATGGTACGCTGAA AGGTTCAGGTCGCTCCATTCAGGGGCTGCATATGCGTGATGCACTGGAGCGATT AGACACACTCTACCCTGGCATGATACTGAAGTTTGGCGGTCATGCGATGGCGGC GGGTTTGTCGCTGGAAGAGGATAAATTCGAACTCTTTCAACAACGGTTTGGCGA GCTGGTTACCGAGTGGCTGGACCCTTCGCTATTGCAAGGCGAAGTGGTGTCAGA CGGCCCGTTAAGCCCGGCCGAAATGACCATGGAAGTGGCGCAGCTGCTGCGCG ATGCTGGCCCGTGGGGCAGATGTTCCCGGAGCCGCTGTTTGATGGTCATTTCC GTCTGCTGCAACAGCGGCTGGTGGGCGAACGTCATTTGAAAGTCATGGTCGAAC CGGTCGGCGGCGGTCCGCTGCTGGATGGTATTGCTTTTAATGTCGATACCGCCCT CTGGCCGGATAACGGCGTGCGCGAAGTGCAACTGGCTTACAAGCTCGATATCAA CGAGTTTCGCGGCAACCGCAGCCTGCAAATTATCATCGACAATATCTGGCCAAT TGGATCCGAATTCGAGCTCCGTCGACAAGCTTGCGGCCGC</u>**ATGTCAATTTATCA AGAATTTGTTAATAAATATAGTTTAAGTAAAACTCTAAGATTTGAGTTAATC CCACAGGGTAAAACACTTGAAAACATAAAAGCAAGAGGTTTGATTTTAGAT GATGAGAAAGAGCTAAAGACTACAAAAAGGCTAAACAAATAATTGATAAA TATCATCAGTTTTTTATAGAGGAGATATTAAGTTCGGTTTGTATTAGCGAAG ATTTATTACAAAACTATTCTGATGTTTATTTTAAACTTAAAAAGAGTGATGA TGATAATCTACAAAAAGATTTTAAAAGTGCAAAAGATACGATAAAGAAACA AATATCTGAATATATAAAGGACTCAGAGAAATTTAAGAATTTGTTTAATCAA AACCTTATCGATGCTAAAAAAGGGCAAGAGTCAGATTTAATTCTATGGCTA AAGCAATCTAAGGATAATGGTATAGAACTATTTAAAGCCAATAGTGATATC ACAGATATAGATGAGGCGTTAGAAATAATCAAATCTTTTAAAGGTTGGACA ACTTATTTTAAGGGTTTTCATGAAAATAGAAAAAATGTTTATAGTAGCAATG ATATTCCTACATCTATTATTTATAGGATAGTAGATGATAATTTGCCTAAATT TCTAGAAAATAAAGCTAAGTATGAGAGTTTAAAAGACAAAGCTCCAGAAGC TATAAACTATGAACAAATTAAAAAAGATTTGGCAGAAGAGCTAACCTTTGA TATTGACTACAAAACATCTGAAGTTAATCAAAGAGTTTTTTCACTTGATGAA GTTTTTGAGATAGCAAACTTTAATAATTATCTAAATCAAAGTGGTATTACTA AATTTAATACTATTATTGGTGGTAAATTTGTAAATGGTGAAAATACAAAGAG AAAAGGTATAAATGAATATATAAATCTATACTCACAGCAAATAATGATAAA ACACTCAAAAAATATAAAATGAGTGTTTATTTAAGCAAATTTTAAGTGATA CAGAATCTAAATCTTTTGTAATTGATAAGTTAGAAGATAGTGATGTAGT TACAACGATGCAAAGTTTTTATGAGCAAATAGCAGCTTTTAAAACAGTAGA AGAAAATCTATTAAAGAAACACTATCTTTATTATTTGATGATTTAAAAGCT CAAAAACTTGATTTGAGTAAAATTTATTTTAAAAATGATAAATCTCTTACTG ATCTATCACAACAAGTTTTTGATGATTATAGTGTTATTGGTACAGCGGTACT AGAATATATAACTCAACAAATAGCACCTAAAAATCTTGATAACCCTAGTAAG AAAGAGCAAGAATTAATAGCCAAAAAAACTGAAAAAGCAAAATACTTATCT CTAGAAACTATAAAGCTTGCCTTAGAAGAATTTAATAAGCATAGAGATATA GATAAACAGTGTAGGTTTGAAGAAATACTTGCAAACTTTGCGGCTATTCCG ATGATATTTGATGAAATAGCTCAAAACAAAGACAATTTGGCACAGATATCT ATCAAATATCAAATCAAGGTAAAAAGACCTACTTCAAGCTAGTGCGGAA GATGATGTTAAAGCTATCAAGGATCTTTTAGATCAAACTAATAATCTCTTAC ATAAACTAAAAATATTTCATATTAGTCAGTCAGAAGATAAGGCAAATATTTT AGACAAGGATGAGCATTTTTATCTAGTATTTGAGGAGTGCTACTTTGAGCT | Underlining indicates Rec J-Bold indicates FnCpf1 |

TABLE 7-continued

| SEQ ID NO | Sequence | Description |
|---|---|---|
| | AGCGAATATAGTGCCTCTTTATAACAAAATTAGAAACTATATAACTCAAAAG<br>CCATATAGTGATGAGAAATTTAAGCTCAATTTTGAGAACTCGACTTTGGCT<br>AATGGTTGGGATAAAAATAAAGAGCCTGACAATACGGCAATTTTATTTATC<br>AAAGATGATAAATATTATCTGGGTGTGATGAATAAGAAAAATAACAAAATA<br>TTTGATGATAAAGCTATCAAAGAAAATAAAGGCGAGGGTTATAAAAAAATT<br>GTTTATAAACTTTTACCTGGCGCAAATAAAATGTTACCTAAGGTTTTCTTTT<br>CTGCTAAATCTATAAAATTTTATAATCCTAGTGAAGATATACTTAGAATAAG<br>AAATCATTCCACACATACAAAAAATGGTAGTCCTCAAAAAGGATATGAAAA<br>ATTTGAGTTTAATATTGAAGATTGCCGAAAATTTATAGATTTTTATAAACAG<br>TCTATAAGTAAGCATCCGGAGTGGAAAGATTTTGGATTTAGATTTTCTGAT<br>ACTCAAAGATATAATTCTATAGATGAATTTTATAGAGAAGTTGAAAATCAAG<br>GCTACAAACTAACTTTTGAAAATATATCAGAGAGCTATATTGATAGCGTAG<br>TTAATCAGGGTAAATTGTACCTATTCCAAATCTATAATAAAGATTTTTCAGC<br>TTATAGCAAAGGGCGACCAAATCTACATACTTTATATTGGAAAGCGCTGTT<br>TGATGAGAGAAATCTTCAAGATGTGGTTTATAAGCTAAATGGTGAGGCAGA<br>GCTTTTTATCGTAAACAATCAATACCTAAAAAAATCACTCACCCAGCTAAA<br>GAGGCAATAGCTAATAAAAACAAAGATAATCCTAAAAAAGAGAGTGTTTTT<br>GAATATGATTTAATCAAAGATAAACGCTTTACTGAAGATAAGTTTTTCTTTC<br>ACTGTCCTATTACAATCAATTTTAAATCTAGTGGAGCTAATAAGTTTAATGA<br>TGAAATCAATTTATTGCTAAAAGAAAAAGCAAATGATGTTCATATATTAAGT<br>ATAGATAGAGGTGAAAGACATTTAGCTTACTATACTTTGGTAGATGGTAAA<br>GGCAATATCATCAAACAAGATACTTTCAACATCATTGGTAATGATAGAATG<br>AAAACAAACTACCATGATAAGCTTGCTGCAATAGAAAAGATAGGGATTCA<br>GCTAGGAAAGACTGGAAAAAGATAAATAACATCAAAGAGATGAAAGAGGG<br>CTATCTATCTCAGGTAGTTCATGAAATAGCTAAGCTAGTTATAGAGTATAAT<br>GCTATTGTGGTTTTTGAGGATTTAAATTTTGGATTTAAAAGAGGGCGTTTCA<br>AGGTAGAAGCAGGTCTATCAAAAGTTAGAAAAAATGCTAATTGAGAAAC<br>TAAACTATCTAGTTTTCAAAGATAATGAGTTTGATAAAACTGGGGGAGTGC<br>TTAGAGCTTATCAGCTAACAGCACCTTTTGAGACTTTTAAAAAGATGGGTA<br>AACAAACAGGTATTATCTACTATGTACCAGCTGGTTTTACTTCAAAAATTTG<br>TCCTGTAACTGGTTTTGTAAATCAGTTATATCCTAAGTATGAAAGTGTCAGC<br>AAATCTCAAGAGTTCTTTAGTAAGTTTGACAAGATTGTTATAACCTTGATA<br>AGGGCTATTTTGAGTTTAGTTTTGATTATAAAAACTTTGGTGACAAGGCTG<br>CCAAAGGCAAGTGGACTATAGCTAGCTTTGGGAGTAGATTGATTAACTTTA<br>GAAATTCAGATAAAAATCATAATTGGGATACTCGAGAAGTTTATCCAACTA<br>AAGAGTTGGAGAAATTGCTAAAAGATTATTCTATCGAATATGGGCATGGCG<br>AATGTATCAAAGCAGCTATTTGCGGTGAGAGCGACAAAAAGTTTTTTGCTA<br>AGCTAACTAGTGTCCTAAATACTATCTTACAAATGCGTAACTCAAAAACAG<br>GTACTGAGTTAGATTATCTAATTTCACCAGTAGCAGATGTAAATGGCAATTT<br>CTTTGATTCGCGACAGGCGCCAAAAAATATGCCTCAAGATGCTGATGCCAA<br>TGGTGCTTATCATATTGGGCTAAAAGGTCTGATGCTACTAGGTAGGATCAA<br>AAATAATCAAGAGGGCAAAAAACTCAATTTGGTTATCAAAAATGAAGAGTA<br>TTTTGAGTTCGTGCAGAATAGGAATAACCAAGCGGCCGCACTCGAGAAAGG<br>CCCGGCGGCCACGAAAAGGCCGGCCAGGCAAAAAGAAAAAGTCGACACCAC<br>CACCACCACCACTGAGATCCGGCTGCTAA | |
| 48 | MGSSHHHHHSSGLVPRGSHMASMTGGQQMGRGS<u>VKQQIQLRRREVDETADLPA</u><br><u>ELPPLLRRLYASRGVRSAQELERSVKGMLPWQQLSGVEKAVEILYNAFREGTRIIVV</u><br><u>GDFDADGATSTALSVLAMRSLGCSNIDYLVPNRFEDGYGLSPEVVDQAHARGAQLI</u><br><u>VTVDNGISSHAGVEHARSLGIPVIVTDHHLPGETLPAAEAI</u>INPNLRDCNFPSKSLAG<br>VGVAFYLMLALRTFLRDQGWFDERGIAIPNLAELLDLVALGTVADVVPLDANNRIL<br>TWQGMSRIRAGKCRPGIKALLEVANRDAQKLAASDLGFALGPRLNAAGRLDDMSV<br>GVALLLCDNIGEARVLANELDALNQTRKEIEQGMQVEALTLCEKLERSRDTLPGGL<br>AMYHPEWHQGVVGILASRIKERFHRPVIAFAPAGDGTLKGSGRSIQGLHMRDALER<br>LDTLYPGMILKFGGHAMAAGLSLEEDKFELFQQRFGELVTEWLDPSLLQGEVVSDG<br>PLSPAEMTMEVAQLLRDAGPWGQMFPEPLFDGHFRLLQQRLVGERHLKVMVEPVG<br>GGPLLDGIAFNVDTALWPDNGVREVQLAYKLDINEFRGNRSLQIIIDNIWPIGSEFEL<br>RRQACGRMSIYQEFVNKYSLSKTLRFELIPQGKTLENIKARGLILDDEKRAKDY<br>KKAKQIIDKYHQFFIEEILSSVCISEDLLQNYSDVYFKLKKSDDDNLQKDFKSAK<br>DTIKKQISEYIKDSEKFKNLFNQNLIDAKKGQESDLILWLKQSKDNGIELFKANS<br>DITDIDEALEIIKSFKGWTTYFKGFHENRKNVYSSNDIPTSHYRIVDDNLPKFLE<br>NKAKYESLKDKAPEAINYEQIKKDLAEELTFDIDYKTSEVNQRVFSLDEVFEIA<br>NFNNYLNQSGITKFNTIIGGKFVNGENTKRKGINEYINLYSQQINDKTLKKYKM<br>SVLFKQILSDTESKSFVIDKLEDDSDVVTTMQSFYEQIAAFKTVEEKSIKETLSLL<br>FDDDLKAQKLDLSKIYFKNDKSLTDLSQQVFDDYSVIGTAVLEYITQQIAPKNLD<br>NPSKKEQELIAKKTEKAKYLSLETIKLALEEFNKHRDIDKQCRFEEILANFAAIP<br>MIFDEIAQNKDNLAQISIKYQNQGKKDLLQASAEDDVKAIKDLLDQTNNLLHK<br>LKIFHISQSEDKANILDKDEHFYLVFEECYFELANIVPLYNKIRNYITQKPYSDE<br>KFKLNFENSTLANGWDKNKEPDNTAILFIKDDKYYLGVMNKKNNKIFDDKAIK<br>ENKGEGYKKIVKLLPGANKMLPKVFFSAKSIKFYNPSEDILRIRNHSTHTKNG<br>SPQKGYEKFEFNIEDCRKFIDFYKQSISKHPEWKDFGFRFSDTQRYNSIDEFYR<br>VENQGYKLTFENISESYIDSVVNQGKLYLFQIYNKDFSAYSKGRPNLIITLYWKA<br>LFDERNLQDVVYKLNGEAELFYRKQSIPKKITHPAKEAIANKNKDNPKKESVFE<br>YDLIKDKRFTEDKFFFHCPITINFKSSGANKFNDEINLLLKEKANDVHILSIDRG<br>ERHLAYYTLVDGKGNIIKQDTFNIIGNDRMKTNYHDKLAAIEKDRDSARKDWK<br>KINNIKEMKEGYLSQVVHEIAKLVIEYNAIVVFEDLNFGFKRGRFKVEKQVYQ | Underlining indicates Rec J-Bold indicates FnCpf1 |

TABLE 7-continued

| SEQ ID NO | Sequence | Description |
|---|---|---|
| | KLEKMLIEKLNYLVFKDNEFDKTGGVLRAYQLTAPFETFKKMGKQTGIIYYVP AGFTSKICPVTGFVNQLYPKYESVSKSQEFFSKFDKICYNLDKGYFEFSFDYKNF GDKAAKGKWTIASEGSRLINFRNSDKNHNWDTREVYPTKELEKLLKDYSIEYG HGECIKAAICGESDKKFFAKLTSVLNTILQMRNSKTGTELDYLISPVADVNGNF FDSRQAPKNMPQDADANGAYHIGLKGLMLLGRIKNNQEGKKLNLVIKNEEYF EFVQNRNNQAAALEKRPAATKKAGQAKKKKSTPPPPPLRSGC | |
| 49 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCC<u>ATGAGT AAAGGAGAAGAACTTTTCACTGGAGTTGTCCCAATTCTTGTTGAATTAGATGGT GATGTTAATGGGCACAAATTTTCTGTCAGTGGAGAGGGTGAAGGTGATGCAACA TACGGAAAACTTACCCTTAAATTTATTTGCACTACTGGAAAACTACCTGTTCCAT GGCCACACTTGTCACTACTTTCTCTTATGGTGTTCAATGCTTTTCAAGATACCC AGATCATATGAAGCGGCACGACTTCTTCAAGAGCGCCATGCCTGAGGGATACGT GCAGGAGAGGACCATCTCTTTCAAGGACGACGGGAACTACAAGACACGTGCTG AAGTCAAGTTTGAGGGAGACACCCTCGTCAACAGGATCGAGCTTAAGGGAATC GATTTCAAGGAGGACGGAAACATCCTCGGCCACAAGTTGGAATACAACTACAA CTCCCACAACGTATACATCACGGCAGACAAACAAAAGAATGGAATCAAAGCTA ACTTCAAAATTAGACACAACATTGAAGATGGAAGCGTTCAACTAGCAGACCATT ATCAACAAATACTCCAATTGGCGATGGCCCTGTCCTTTTACCAGACAACCATT ACCTGTCCACACAATCTGCCCTTTCGAAAGATCCCAACGAAAAGAGAGACCACA TGGTCCTTCTTGAGTTTGTAACAGCTGCTGGGATTACACATGGCATGGATGAACT ATACAAAGGATCCGAATTCGAGCTCCGTCGACAAGCTTGCGGCCGC</u>**ATGTCAA TTTATCAAGAATTTGTTAATAAATATAGTTTAAGTAAAACTCTAAGATTTGA GTTAATCCCACAGGGTAAAACACTTGAAAACATAAAAGCAAGAGGTTTGAT TTTAGATGATGAGAAAAGAGCTAAAGACTACAAAAAGGCTAAACAAATAAT TGATAAATATCATCAGTTTTTTATAGAGGAGATATTAAGTTCGGTTTGTATT AGCGAAGATTTATTACAAAACTATTCTGATGTTTATTTTAAACTTAAAAGA GTGATGATGATAATCTACAAAAAGATTTTAAAAGTGCAAAAGATACGATAA AGAAACAAATATCTGAATATATAAAGGACTCAGAGAAATTTAAGAATTTGT TTAATCAAACCTTATCGATGCTAAAAAAGGGCAAGAGTCAGATTTAATTC TATGGCTAAAGCAATCTAAGGATAATGGTATAGAACTATTTAAAGCCAATA GTGATATCACAGATATAGATGAGGCGTTAGAAATAATCAAATCTTTTAAAG GTTGGACAACTTATTTTAAGGGTTTTCATGAAAATAGAAAAAATGTTTATAG TAGCAATGATATTCCTACATCTATTATTTATAGGATAGTAGATGATAATTTG CCTAAATTTCTAGAAAATAAAGCTAAGTATGAGAGTTTAAAAGACAAAGCT CCAGAAGCTATAAACTATGAACAAATTAAAAAAGATTTGGCAGAAGAGCTA ACCTTTGATATTGACTACAAAACATCTGAAGTTAATCAAAGAGTTTTTTCAC TTGATGAAGTTTTTGAGATAGCAAACTTTAATAATTATCTAAATCAAAGTGG TATTACTAAATTTAATACTATTATTGGTGGTAAATTTGTAAATGGTGAAAAT ACAAAGAGAAAAGGTATAAATGAATATATAAATCTATACTCACAGCAAATA AATGATAAAACACTCAAAAAATATAAAATGAGTGTTTTATTTAAGCAAATTT TAAGTGATACAGAATCTAAATCTTTTGTAATTGATAAGTTAGAAGATGATAG TGATGTAGTTACAACGATGCAAAGTTTTTATGAGCAAATAGCAGCTTTTAA AACAGTAGAAGAAAAATCTATTAAAGAAACACTATCTTTATTATTTGATGAT TTAAAAGCTCAAAAACTTGATTTGAGTAAAATTTATTTTAAAAATGATAAAT CTCTTACTGATCTATCACAACAAGTTTTTGATGATTATAGTGTTATTGGTAC AGCGGTACTAGAATATATAACTCAACAAATAGCACCTAAAAATCTTGATAA CCCTAGTAAGAAAGAGCAAGAATTAATAGCCAAAAAAACTGAAAAAGCAAA ATACTTATCTCTAGAAACTATAAAGCTTGCCTTAGAAGAATTTAATAAGCAT AGAGATATAGATAAACAGTGTAGGTTTGAAGAAATACTTGCAAACTTTGCG GCTATTCCGATGATATTTGATGAAATAGCTCAAAACAAAGACAATTTGGCA CAGATATCTATCAAATATCAAAATCAAGGTAAAAAAGACCTACTTCAAGCTA GTGCGGAAGATGATGTTAAAGCTATCAAGGATCTTTTAGATCAAACTAATA ATCTCTTACATAAACTAAAAATATTTCATATTAGTCAGTCAGAAGATAAGGC AAATATTTTAGACAAGGATGAGCATTTTTATCTAGTATTTGAGGAGTGCTAC TTTGAGCTAGCGAATATAGTGCCTCTTTATAACAAAATTAGAAACTATATAA CTCAAAAGCCATATAGTGATGAGAAATTTAAGCTCAATTTTGAGAACTCGA CTTTGGCTAATGGTTGGGATAAAAATAAAGAGCCTGACAATACGGCAATTT TATTTATCAAAGATGATAAATATTATCTGGGTGTGATGAATAAGAAAATAA CAAAATATTTGATGATAAAGCTATCAAAGAAAATAAAGGCGAGGGTTATAA AAAAATTGTTTATAAACTTTTACCTGGCGCAAATAAAATGTTACCTAAGGTT TTCTTTTCTGCTAAATCTATAAAATTTTATAATCCTAGTGAAGATACATTA GAATAAGAAATCATTCCACACATACAAAAAATGGTAGTCCTCAAAAAGGAT ATGAAAAATTTGAGTTTAATATTGAAGATTGCCGAAAATTTATAGATTTTA TAAACAGTCTATAAGTAAGCATCCGGAGTGGAAAGATTTTGGATTTAGATT TTCTGATACTCAAAGATATAATTCTATAGATGAATTTTATAGAGAAGTTGAA AATCAAGGCTACAAACTAACTTTTGAAAATATATCAGAGAGCTATATTGATA GCGTAGTAATCAGGGTAAATTGTACCTATTCCAAATCTATAATAAAGATTT TTCAGCTTATAGCAAAGGGCGACCAAATCTACATCTTTATATTGGAAAGC GCTGTTTGATGAGAAATCTTCAAGATGTGGTTTATAAGCTAAATGGTTA GGCAGAGCTTTTTTATCGTAAACAATCAATACCTAAAAAAATCACTCACCCA GCTAAAGAGGCAATAGCTAATAAAACAAAGATAATCCTAAAAAAGAGAGT GTTTTTGAATATGATTTAATCAAAGATAAACGCTTTACTGAAGATAAGTTTT TCTTTCACTGTCCTATTACAATCAATTTTAAATCTAGTGGAGCTAATAAGTT TAATGATGAAATCAATTTATTGCTAAAAGAAAAAGCAAATGATGTTCATATA | Underlining indicates GFP-Bold indicates FnCpf1 |

TABLE 7-continued

| SEQ ID NO | Sequence | Description |
|---|---|---|
| | TTAAGTATAGATAGAGGTGAAAGACATTTAGCTTACTATACTTTGGTAGAT<br>GGTAAAGGCAATATCATCAAACAAGATACTTTCAACATCATTGGTAATGAT<br>AGAATGAAAACAAACTACCATGATAAGCTTGCTGCAATAGAGAAAGATAGG<br>GATTCAGCTAGGAAAGACTGGAAAAAGATAAATAACATCAAAGAGATGAAA<br>GAGGGCTATCTATCTCAGGTAGTTCATGAAATAGCTAAGCTAGTTATAGAG<br>TATAATGCTATTGTGGTTTTTGAGGATTTAAATTTTGGATTTAAAAGAGGGC<br>GTTTCAAGGTAGAGAAGCAGGTCTATCAAAAGTTAGAAAAAATGCTAATTG<br>AGAAACTAAACTATCTAGTTTTCAAAGATAATGAGTTTGATAAAACTGGGG<br>GAGTGCTTAGAGCTTATCAGCTAACAGCACCTTTTGAGACTTTTAAAAAGA<br>TGGGTAAACAAACAGGTATTATCTACTATGTACCAGCTGGTTTTACTTCAAA<br>AATTTGTCCTGTAACTGGTTTTGTAAATCAGTTATATCCTAAGTATGAAAGT<br>GTCAGCAAATCTCAAGAGTTCTTTAGTAAGTTTGACAAGATTTGTTATAACC<br>TTGATAAGGGCTATTTTGAGTTTAGTTTTGATTATAAAAACTTTGGTGACAA<br>GGCTGCCAAAGGCAAGTGGACTATAGCTAGCTTTGGGAGTAGATTGATTAA<br>CTTTAGAAATTCAGATAAAAATCATAATTGGGATACTGAGAAGTTTATCCA<br>ACTAAAGAGTTGGAGAAATTGCTAAAAGATTATTCTATCGAATATGGGCAT<br>GGCGAATGTATCAAAGCAGCTATTTGCGGTGAGAGCGACAAAAAGTTTTTT<br>GCTAAGCTAACTAGTGTCCTAAATACTATCTTACAAATGCGTAACTCAAAAA<br>CAGGTACTGAGTTAGATTATCTAATTTCACCAGTAGCAGATGTAAATGGCA<br>ATTTCTTTGATTCGCGACAGGCGCCAAAAAATATGCCTCAAGATGCTGATG<br>CCAATGGTGCTTATCATATTGGGCTAAAGGTCTGATGCTACTAGGTAGGA<br>TCAAAATAATCAAGAGGGCAAAAAACTCAATTTGGTTATCAAAAATGAAG<br>AGTATTTTGAGTTCGTGCAGAATAGGAATAACCAAGCGGCCGCACTCGAGAA<br>AAGGCCGGCGGCCACGAAAAAGGCCGGCCAGGCAAAAAAGAAAAAGTCGACA<br>CCACCACCACCACCACTGAGATCCGGCTGCTAA | |
| 50 | MGSSHHHHHHSSGLVPRGSHMASMTGGQQMGRGSMSKGEELFTGVVPILVELDG<br><u>DVNGHKFSVSGEGEGDATYGKLTLKFICTTGKLPVPWPTLVTTFSYGVQCFSRYPD</u><br><u>HMKRHDFFKSAMPEGYVQERTISFKDDGNYKTRAEVKFEGDTLVNRIELKGIDFKE</u><br><u>DGNILGHKLEYNYNSHNVYITADKQKNGIKANFKIRHNIEDGSVQLADHYQQNTPI</u><br><u>GDGPVLLPDNHYLSTQSALSKDPNEKRDHMVLLEFVTAAGITHGMDELYKGSEFEL</u><br>RRQACGRMSIYQEFVNKYSLSKTLRFELIPQGKTLENIKARGLILDDEKRAKDY<br>KKAKQIIDKYHQFFIEEILSSVCISEDLLQNYSDVYFKLKKSDDDNLQKDFKSAK<br>DTIKKQISEYIKDSEKFKNLFNQNLIDAKKGQESDLILWLKQSKDNGIELFKANS<br>DITDIDEALEIIKSFKGWTTYFKGFHENRKNVYSSNDIPTSHYRIVDDNLPKFLE<br>NKAKYESLKDKAPEAINYEQIKKDLAEELTFDIDYKTSEVNQRVFSLDEVFEIA<br>NFNNYLNQSGITKFNTIIGGKFVNGENTKRKGINEYINLYSQQINDKTLKKYKM<br>SVLFKQILSDTESKSFVIDKLEDDSDVVTTMQSFYEQIAAFKTVEEKSIKETLSLL<br>FDDLKAQKLDLSKIYFKNDKSLTDISQQVFDDYSVIGTAVLEYITQQIAPKNLD<br>NPSKKEQELIAKKTEKAKYLSLETIKLALEEFNKHRDIDKQCRFEEILANFAMP<br>MIFDEIAQNKDNLAQISIKYQNQGKKDLLQASAEDDVKAIKDLLDQTNNLLHK<br>LKIFHISQSEDKANILDKDEHFYLVFEECYFELANIVPLYNKIRNYITQKPYSDE<br>KFKLNFENSTLANGWDKNKEPDNTAILFIKDDKYYLGVMNKKNNKIFDDKAIK<br>ENKGEGYKKIVYKLLPGANKMLPKVFFSAKSIKFYNPSEDILRIRNHSTHTKNG<br>SPQKGYEKFEFNIEDCRKFIDFYKQSISKHPEWKDFGFRFSDTQRYNSIDEFYRE<br>VENQGYKLTFENISESYIDSVVNQGKLYLFQIYNKDFSAYSKGRPNLHTLYWKA<br>LFDERNLQDVVYKLNGEAELFYRKQSIPKKITHPAKEAIANKNKDNPKKESVFE<br>YDLIKDKRFTEDKFFFHCPITINFKSSGANKFNDEINLLLKEKANDVHILSIDRG<br>ERHLAYYTLVDGKGNIIKQDTFNIIGNDRMKTNYHDKLAAIEKDRDSARKDWK<br>KINNIKEMKEGYLSQVVHEIAKLVIEYNAIVVFEDLNFGFKRGRFKVEKQVYQ<br>KLEKMLIEKLNYLVFKDNEFDKTGGVLRAYQLTAPFETFKKMGKQTGIIYYVP<br>AGFTSKICPVTGFVNQLYPKYESVSKSQEFFSKFDKICYNLDKGYFEFSFDYKNF<br>GDKAAKGKWTIASFGSRLINFRNSDKNHNWDTREVYPTKELEKLLKDYSIEYG<br>HGECIKAAICGESDKKFFAKLTSVLNTILQMRNSKTGTELDYLISPVADVNGNF<br>FDSRQAPKNMPQDADANGAYHIGLKGLMLLGRIKNNQEGKKLNLVIKNEEYF<br>EFVQNRNNQAAALEKRPAATKKAGQAKKKKSTPPPPPLRSGC | Underlining indicates GFP-Bold indicates FnCpf1 |
| 51 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCC<u>ATGGCC</u><br><u>AGCAGAGGCGTAAACAAGGTTATTCTCGTTGGTAATCTGGGTCAGGACCCGGAA</u><br><u>GTACGCTACATGCCAAATGGTGGCCAGTTGCCAACATTACGCTGGCTACTTCC</u><br><u>GAATCCTGGCGTGATAAAGCGACCGGCGAGATGAAAGAACAGACTGAATGGCA</u><br><u>CCGCGTTGTGCTGTTCCGGCAAACTGGCAGAAGTGGCGAGCGAATATCTGCGTAA</u><br><u>AGGTTCTCAGGTTTATATCGAAGGTCAGCTGCGTACCCGTAAATGGACCGATCA</u><br><u>ATCCGGTCAGGATCGCTACACCACAGAAGTCGTGGTGAACGTTGGCGGCACCAT</u><br><u>GCAGATGCTGGGTGGTCGTGGATCCGAATTCGAGCTCCGTCGACAAGCTTGCGG</u><br>CCGCATGTCAATTTATCAAGAATTTGTTAATAAATATAGTTTAAGTAAAACT<br>CTAAGATTTGAGTTAATCCCACAGGGTAAAACACTTGAAAACATAAAAGCA<br>AGAGGTTTGATTTTAGATGATGAGAAAAGAGCTAAAGACTACAAAAAGGCT<br>AAACAAATAATTGATAAATATCATCAGTTTTTTATAGAGGAGATATTAAGTT<br>CGGTTTGTATTAGCGAAGATTTATTACAAAACTATTCTGATGTTTATTTTAA<br>ACTTAAAAAGAGTGATGATGATAATCTACAAAAAGATTTTAAAAGTGCAAA<br>AGATACGATAAAGAAACAAATATCTGAATATATAAAGGACTCAGAGAAATT<br>TAAGAATTTGTTTAATCAAAACCTTATCGATGCTAAAAAAGGGCAAGAGTC<br>AGATTTAATTCTATGGCTAAAGCAATCTAAGGATAATGGTATAGAACTATTT<br>AAAGCCAATAGTGATATCACAGATATAGATGAGGCGTTAGAAATAATCAAA | Underlining indicates SSB-Bold indicates FnCpf1 |

TABLE 7-continued

| SEQ ID NO | Sequence | Description |
|---|---|---|
| | TCTTTTAAAGGTTGGACAACTTATTTTAAGGGTTTTCATGAAAATAGAAAAA<br>ATGTTTATAGTAGCAATGATATTCCTACATCTATTATTTATAGGATAGTAGA<br>TGATAATTTGCCTAAATTTCTAGAAAATAAAGCTAAGTATGAGAGTTTAAAA<br>GACAAAGCTCCAGAAGCTATAAACTATGAACAAATTAAAAAAGATTTGGCA<br>GAAGAGCTAACCTTTGATATTGACTACAAAACATCTGAAGTTAATCAAAGA<br>GTTTTTTCACTTGATGAAGTTTTTGAGATAGCAAACTTTAATAATTATCTAA<br>ATCAAAGTGGTATTACTAAATTTAATACTATTATTGGTGGTAAATTTGTAAA<br>TGGTGAAAATACAAAGAGAAAAGGTATAAATGAATATATAAATCTATACTC<br>ACAGCAAATAAATGATAAAACACTCAAAAAATATAAAATGAGTGTTTTATTT<br>AAGCAAATTTTAAGTGATACAGAATCTAAATCTTTTGTAATTGATAAGTTAG<br>AAGATGATAGTGATGTAGTTACAACGATGCAAAGTTTTTATGAGCAAATAG<br>CAGCTTTTAAAACAGTAGAAGAAAAATCTATTAAAGAAACACTATCTTTATT<br>ATTTGATGATTTAAAAGCTCAAAAACTTGATTTGAGTAAAATTTATTTTAAA<br>AATGATAAATCTCTTACTGATCTATCACAACAAGTTTTTGATGATTATAGTG<br>TTATTGGTACAGCGGTACTAGAATATATAACTCAACAAATAGCACCTAAAA<br>ATCTTGATAACCCTAGTAAGAAAGAGCAAGAATTAATAGCCAAAAAAACTG<br>AAAAAGCAAAATACTTATCTCTAGAAACTATAAAGCTTGCCTTAGAAGAATT<br>TAATAAGCATAGAGATATAGATAAACAGTGTAGGTTTGAAGAAATACTTGC<br>AAACTTTGCGGCTATTCCGATGATATTTGATGAAATAGCTCAAACAAAGA<br>CAATTTGGCACAGATATCTATCAAATATCAAATCAAGGTAAAAAAGACCT<br>ACTTCAAGCTAGTGCGGAAGATGATGTTAAAGCTATCAAGGATCTTTTAGA<br>TCAAACTAATAATCTCTTACATAAACTAAAAATATTTCATATTAGTCAGTCA<br>GAAGATAAGGCAAATATTTTAGACAAGGATGAGCATTTTTATCTAGTATTT<br>GAGGAGTGCTACTTTGAGCTAGCGAATATAGTGCCTCTTTATAACAAAATT<br>AGAAACTATATAACTCAAAAGCCATATAGTGATGAGAAATTTAAGCTCAATT<br>TTGAGAACTCGACTTTGGCTAATGGTTGGGATAAAAATAAAGAGCCTGACA<br>ATACGGCAATTTTATTTATCAAAGATGATAAATATTATCTGGGTGTGATGAA<br>TAAGAAAAATAACAAATATTTGATGATAAAGCTATCAAAGAAAATAAAGG<br>CGAGGGTATAAAAAAATTGTTTATAAACTTTTACCTGGCGCAAATAAAAT<br>GTTACCTAAGGTTTTCTTTTCTGCTAAATCTATAAAATTTTATAATCCTAGT<br>GAAGATATACTTAGAATAAGAAATCATTCCACACATACAAAAAATGGTAGT<br>CCTCAAAAAGGATATGAAAAATTTGAGTTTAATATTGAAGATTGCCGAAAA<br>TTTATAGATTTTTATAAACAGTCTATAAGTAAGCATCCGGAGTGGAAAGATT<br>TTGGATTTAGATTTTCTGATACTCAAAGATATAATTCTATAGATGAATTTTA<br>TAGAGAAGTTGAAAATCAAGGCTACAAACTAACTTTTGAAAATATATCAGA<br>GAGCTATATTGATAGCGTAGTTAATCAGGGTAAATTGTACCTATTCCAAAT<br>CTATAATAAAGATTTTTCAGCTTATAGCAAAGGGCGACCAAATCTACATACT<br>TTATATTGGAAAGCGCTGTTTGATGAGAGAAATCTTCAAGATGTGGTTTAT<br>AAGCTAAATGGTGAGGCAGAGCTTTTTTATCGTAAACAATCAATACCTAAA<br>AAAATCACTCACCCAGCTAAAGAGGCAATAGCTAATAAAAACAAAGATAAT<br>CCTAAAAAAGAGAGTGTTTTTGAATATGATTTAATCAAAGATAAACGCTTTA<br>CTGAAGATAAGTTTTTCTTTCACTGTCCTATTACAATCAATTTTAAATCTAG<br>TGGAGCTAATAAGTTAATGATGAAATCAATTTATTGCTAAAAGAAAAAGC<br>AAATGATGTTCATATATTAAGTATAGATAGAGGTGAAAGACATTTAGCTTA<br>CTATACTTTGGTAGATGGTAAAGGCAATATCATCAAACAAGATACTTTCAA<br>CATCATTGGTAATGATAGAATGAAAACAAACTACCATGATAAGCTTGCTGC<br>AATAGAGAAAGATAGGGATTCAGCTAGGAAAGACTGGAAAAAGATAAATAA<br>CATCAAAGAGATGAAAGAGGGCTATCTATCTCAGGTAGTTCATGAAATAGC<br>TAAGCTAGTTATAGAGTATAATGCTATTGTGGTTTTTGAGGATTTAAATTTT<br>GGATTTAAAAGAGGGCGTTTCAAGGTAGAGAAGCAGGTCTATCAAAAGTTA<br>GAAAAAATGCTAATTGAGAACTAAACTATCTAGTTTTCAAAGATAATGAG<br>TTTGATAAAACTGGGGGAGTGCTTAGAGCTTATCAGCTAACAGCACCTTTT<br>GAGACTTTTAAAAAGATGGGTAAACAAACAGGTATTATCTACTATGTACCA<br>GCTGGTTTTACTTCAAAAAATTTGTCCTGTAACTGGTTTTGTAAATCAGTTAT<br>ATCCTAAGTATGAAAGTGTCAGCAAATCTCAAGAGTTCTTTAGTAAGTTTG<br>ACAAGATTGTTATAACCTTGATAAGGGCTATTTTGAGTTTAGTTTTGATTA<br>TAAAAACTTTGGTGACAAGGCTGCCAAAGGCAAGTGGACTATAGCTAGCTT<br>TGGGAGTAGATTGATTAACTTTAGAAATTCAGATAAAAATCATAATTGGGA<br>TACTCGAGAAGTTTATCCAACTAAAGAGTTGGAGAAATTGCTAAAAGATTA<br>TTCTATCGAATATGGGCATGGCGAATGTATCAAAGCAGCTATTTGCGGTGA<br>GAGCGACAAAAAGTTTTTTGCTAAGCTAACTAGTGTCCTAAATACTATCTTA<br>CAAATGCGTAACTCAAAAACAGGTACTGAGTTAGATTATCTAATTTCACCA<br>GTAGCAGATGTAAATGGCAATTTCTTTGATTCGCGACAGGCGCCAAAAAAT<br>ATGCCTCAAGATGCTGATGCCAATGGTGCTTATCATATTGGGCTAAAAGGT<br>CTGATGCTACTAGGTAGGATCAAAAATAATCAAGAGGGCAAAAAACTCAAT<br>TTGGTTATCAAAAATGAAGAGTATTTTGAGTTCGTGCAGAATAGGAATAAC<br>CAAGCGGCCGCACTCGAGAAAAGGCCGGCGGCCACGAAAAGGCCGGCCAGG<br>CAAAAAAGAAAAAGTCGACACCACCACCACCACCACTGAGATCCGGCTGCTAA | |
| 52 | MGSSHHHHHHSSGLVPRGSHMASMTGGQQMGRGS<u>MASRGVNKVILVGNLGQDPE</u><br><u>VRYMMPNGGAVANITLATSESWRDKATGEKEQTEWHRVVLFGKLAEVASEYLRK</u><br><u>GSQVYIEGQLRTRKWTDQSGQDRYTTEVVNVGGTMQMLGGRGS</u>EFELRRQACG<br>RMSIYQEFVNKYSLSKTERFELIPQGKTLENIKARGLILDDEKRAKDYKKAKQI<br>IDKYHQFFIEEILSSVCISEDLLQNYSDVYFKLKICSDDDNLQKDFKSAKDTIKKQ<br>ISEYIKDSEKEKNLENQNLIDAKKGQESDLIEWLKQSKDNGIELFKANSDITDID<br>EALEIIKSFKGWTTYFKGEHENRKNVYSSNDIPTSIIYRIVDDNLPKFLENKAKY | Underlining indicates SSB-Bold indicates FnCpf1 |

| SEQ ID NO | Sequence | Description |
|---|---|---|
| | ESLKDKAPEAINYEQIKKDLAEELTEDIDYKTSEVNQRVESLDEVFEIANENNYL NQSGITKENTIIGGKEVNGENTKRKGINEYINLYSQQINDKTEKKYKMSVLEKQ ILSDTESKSEVIDKLEDDSDVVTTMQSFYEQIAAFKTVEEKSIKETLSELFDDLK AQKLDLSKIYEKNDKSLTDESQQVFDDYSVIGTAVLEYITQQIAPKNEDNPSKK EQELIAKKTEKAKYLSLETIKLALEEENKHRDIDKQCRFEEILANFAAIPMIFDE IAQNKDNLAQISIKYQNQGKKDLLQASAEDDVKAIKDELDQTNNELHKEKIFHI SQSEDKANILDKDEHFYLVFEECYFELANIVPLYNKIRNYITQKPYSDEKFKLNE ENSTLANGWDKNKEPDNTAILFIKDDKYYLGVMNKKNNKIFDDKAIKENKGE GYKKIVYKLLPGANKMLPKVFFSAKSIKEYNPSEDILRIRNHSTHTKNGSPQKG YEKFEENIEDCRKFIDEYKQSISKHPEWKDEGFRESDTQRYNSIDEFYREVENQG YKLTFENISESYIDSVVNQGKLYLFQIYNKDFSAYSKGRPNLIITLYWKALFDER NLQDVVYKENGEAELFYRKQSIPKKITHPAKEAIANKNKDNPKKESVFEYDLIK DKRFTEDKFFFHCPITINFKSSGANKFNDEINLLLKEKANDVHILSIDRGERHLA YYTLVDGKGNIIKQDTFNIIGNDRMKTNYHDKLAAIEKDRDSARKDWKKINNI KEMKEGYLSQVVHEIAKLVIEYNAIVVFEDLNFGFKRGRFKVEKQVYQKLEK MLIEKLNYLVFKDNEFDKTGGVLRAYQLTAPFETFKKMGKQTGIIYYVPAGFT SKICPVTGFVNQLYPKYESVSKSQEFFSKFDKICYNLDKGYFEFSFDYKNFGDK AAKGKWTIASFGSRLINFRNSDKNHNWDTREVYPTKELEKLLKDYSIEYGHGE CIKAAICGESDKKFFAKLTSVLNTILQMRNSKTGTELDYLISPVADVNGNFFDSR QAPKNMPQDADANGAYHIGLKGLMLLGRIKNNQEGKKLNLVIKNEEYFEFVQ NRNNQAALEKRPAATKKAGQAKKKKSTPPPPPLRSGC | |
| 53 | ATGGGCAGCAGCCATCATCATCATCATCACAGCAGCGGCCTGGTGCCGCGCGGC AGCCATATGGCTAGCATGACTGGTGGACAGCAAATGGGTCGCGGATCC<u>ATGGCC AGCAGAGGCGTAAACAAGGTTATTCTCGTTGGTAATCTGGGTCAGGACCCGGAA GTACGCTACATGCCAAATGGTGGCGCAGTTGCCAACATTACGCTGGCTACTTCC GAATCCTGGCGTGATAAAGCGACCGGCGAGATGAAGAACAGACTGAATGGCA CCGCGTTGTGCTGTTCGGCAAACTGGCAGAAGTGGCGAGCGAATATCTGCGTAA AGGTTCTCAGGTTTATATCGAAGGTCAGCTGCCTACCCGTAAATGGACCGATCA ATCCGGTCAGGATCGCTACACCACAGAAGTCGTGGTGAACGTTGGCGGCACCAT GCAGATGCTGGGTGGTCGTGGATCCGAATTCGAGCTCCGTCGACAAGCTTGCGG CCGC</u>*ATGTCAATTTATCAAGAATTTGTTAATAAATATAGTTTAAGTAAAACT CTAAGATTTGAGTTAATCCCACAGGGTAAAACATTGAAAACATAAAAGCA AGAGGTTTGATTTTAGATGATGAGAAAAGAGCTAAAGACTACAAAAAGGCT AAACAAATAATTGATAAATATCATCAGTTTTTTATAGAGGAGATATTAAGTT CGGTTTGTATTAGCGAAGATTTATTACAAAACTATTCTGATGTTTATTTTAA ACTTAAAAAGAGTGATGATGATAATCTACAAAAAGATTTTAAAAGTGCAAA AGATACGATAAAGAAACAAATATCTGAATATATAAAGGACTCAGAGAAATT TAAGAATTTGTTTAATCAAAACCTTATCGATGCTAAAAAAGGGCAAGAGTC AGATTTAATTCTATGGCTAAAGCAATCTAAGGATAATGGTATAGAACTATTT AAAGCCAATAGTGATATCACAGATATAGATGAGGCGTTAGAAATAATCAAA TCTTTTAAAGGTTGGACAACTTATTTTAAGGGTTTTCATGAAAATGAAAAA ATGTTTATAGTAGCAATGATATTCCTACATCTATTATTTATAGGATAGTAGA TGATAATTTGCCTAAATTTCTAGAAAATAAAGCTAAGTATGAGAGTTTAAAA GACAAAGCTCCAGAAGCTATAAACTATGAACAAATTAAAAAAGATTTGGCA GAAGAGCTAACCTTTGATATTGACTACAAAACATCTGAAGTTAATCAAAGA GTTTTTTCACTTGATGAAGTTTTTGAGATAGCAAACTTTAATAATTATCTAA ATCAAAGTGGTATTACTAAATTTAATACTATTATTGGTGGTAAATTTGTAAA TGGTGAAAATACAAAGAGAAAAGGTATAAATGAATATATAAATCTATACTC ACAGCAAATAAATGATAAAACACTCAAAAAATATAAAATGAGTGTTTTATTT AAGCAAATTTTAAGTGATACAGAATCTAAATCTTTTGTAATTGATAAGTTAG AAGATGATAGTGATGTAGTTACAACGATGCAAAGTTTTTATGAGCAAATAG CAGCTTTTAAAACAGTAGAAGAAAAATCTATTAAAGAAACACTATCTTTATT ATTTGATGATTTAAAAGCTCAAAAACTTGATTTGAGTAAAATTTATTTTAAA AATGATAAATCTCTTACTGATCTATCACAACAAGTTTTTGATGATTATAGTG TTATTGGTACAGCGGTACTAGAATATATAACTCAACAAATAGCACCTAAAA ATCTTGATAACCCTAGTAAGAAAGAGCAAGAATTAATAGCCAAAAAAACTG AAAAAGCAAAATACTTATCTCTAGAAACTATAAAGCTTGCCTTAGAAGAATT TAATAAGCATAGAGATATAGATAAACAGTGTAGGTTTGAAGAAATACTTGC AAACTTTGCGGCTATTCCGATGATATTTGATGAAATAGCTCAAAACAAAGA CAATTTGGCACAGATATCTATCAAATATCAAAATCAAGGTAAAAAAGACCT ACTTCAAGCTAGTGCGGAAGATGATGTTAAAGCTATCAAGGATCTTTTAGA TCAAACTAATAATCTCTTACATAAACTAAAAATATTTCATATTAGTCAGTCA GAAGATAAGGCAAATATTTTAGACAAGGATGAGCATTTTTATCTAGTATTT GAGGAGTGCTACTTTGAGCTAGCGAATATAGTGCCTCTTTATAACAAAATT AGAAACTATATAACTCAAAAGCCATATAGTGATGAGAAATTTAAGCTCAATT TTGAGAACTCGACTTTGGCTAATGGTTGGGATAAAAATAAAGAGCCTGACA ATACGGCAATTTTATTTATCAAAGATGATAAATATTATCTGGGTGTGATGAA TAAGAAAAATAACAAATATTTGATGATAAAGCTATCAAAGAAATAAAGG CGAGGGTTATAAAAAAATTGTTTATAAACTTTTACCTGGCGCAAATAAAAT GTTACCTAAGGTTTTCTTTTCTGCTAAATCTATAAAATTTTATAATCCTAGT GAAGATATACTTAGAATAAGAAATCATTCCACACATACAAAAAATGGTAGT CCTCAAAAAGGATATGAAAAATTTGAGTTTAATATTGAAGATTGCCGAAAA TTTATAGATTTTTATAAACAGTCTATAAGTAAGCATCCGGAGTGGAAAGATT TTGGATTTAGATTTTCTGATACTCAAAGATATAATTCTATAGATGAATTTTA TAGAGAAGTTGAAAATCAAGGCTACAAACTAACTTTTGAAAATATATCAGA* | Underlining indicates SSB- Bold indicates FnCpf1- Italics indicates RecJ |

TABLE 7-continued

| SEQ ID NO | Sequence | Description |
|---|---|---|
| | GAGCTATATTGATAGCGTAGTTAATCAGGGTAAATTGTACCTATTCCAAAT<br>CTATAATAAAGATTTTTCAGCTTATAGCAAAGGGCGACCAAATCTACATACT<br>TTATATTGGAAAGCGCTGTTTGATGAGAGAAATCTTCAAGATGTGGTTTAT<br>AAGCTAAATGGTGAGGCAGAGCTTTTTTATCGTAAACAATCAATACCTAAA<br>AAAATCACTCACCCAGCTAAAGAGGCAATAGCTAATAAAAACAAAGATAAT<br>CCTAAAAAAGAGAGTGTTTTTGAATATGATTTAATCAAAGATAAACGCTTTA<br>CTGAAGATAAGTTTTTCTTTCACTGTCCTATTACAATCAATTTTAAATCTAG<br>TGGAGCTAATAAGTTTAATGATGAAATCAATTTATTGCTAAAAGAAAAAGC<br>AAATGATGTTCATATATTAAGTATAGATAGAGGTGAAAGACATTTAGCTTA<br>CTATACTTTGGTAGATGGTAAAGGCAATATCATCAAACAAGATACTTTCAA<br>CATCATTGGTAATGATAGAATGAAAACAAACTACCATGATAAGCTTGCTGC<br>AATAGAGAAAGATAGGGATTCAGCTAGGAAAGACTGGAAAAAGATAAATAA<br>CATCAAAGAGATGAAAGAGGGCTATCTATCTCAGGTAGTTCATGAAATAGC<br>TAAGCTAGTTATAGAGTATAATGCTATTGTGGTTTTTGAGGATTTAAATTTT<br>GGATTTAAAAGAGGGCGTTTCAAGGTAGAGAAGCAGGTCTATCAAAAGTTA<br>GAAAAAATGCTAATTGAGAAACTAAACTATCTAGTTTTCAAAGATAATGAG<br>TTTGATAAAACTGGGGAGTGCTTAGAGCTTATCAGCTAACAGCACCTTTT<br>GAGACTTTTAAAAAGATGGGTAAACAAACAGGTATTATCTACTATGTACCA<br>GCTGGTTTTACTTCAAAAATTTGTCCTGTAACTGGTTTTGTAAATCAGTTAT<br>ATCCTAAGTATGAAAGTGTCAGCAAATCTCAAGAGTTCTTTAGTAAGTTTG<br>ACAAGATTTGTTATAACCTTGATAAGGGCTATTTTGAGTTTAGTTTTGATTA<br>TAAAAACTTTGGTGACAAGGCTGCCAAAGGCAAGTGGACTATAGCTAGCTT<br>TGGGAGTAGATTGATTAACTTTAGAAATTCAGATAAAAATCATAATTGGGA<br>TACTCGAGAAGTTTATCCAACTAAAGAGTTGGAGAAATTGCTAAAAGATTA<br>TTCTATCGAATATGGGCATGGCGAATGTATCAAAGCAGCTATTTGCGGTGA<br>GAGCGACAAAAAGTTTTTTGCTAAGCTAACTAGTGTCCTAAATACTATCTTA<br>CAAATGCGTAACTCAAAAACAGGTACTGAGTTAGATTATCTAATTTCACCA<br>GTAGCAGATGTAAATGGCAATTTCTTTGATTCGCGACAGGCGCCAAAAAAT<br>ATGCCTCAAGATGCTGATGCCAATGGTGCTTATCATATTGGGCTAAAAGGT<br>CTGATGCTACTAGGTAGGATCAAAAATAATCAAGAGGGCAAAAAACTCAAT<br>TTGGTTATCAAAAATGAAGAGTATTTTGAGTTCGTGCAGAATAGGAATAAC<br>CA AGCGGCCGCACTCGACCTGCAGGTGAAACAACAGATACAACTTCGTCGCCGTGA<br>AGTCGATGAAACGGCAGACTTGCCCGCTGAATTGCCTCCCTTGCTGCGCCGTTTATA<br>CGCCAGCCGGGGAGTACGCAGTGCGCAAGAACTGGAACGCAGTGTTAAAGGTATGC<br>TGCCCTGGCAGCAACTGAGCGGCGTCGAAAAGGCCGTTGAGATCCTTTACAACGCTT<br>TTCGCGAAGGAACGCGGATTATTGTGGTCGGTGATTTCGACGCCGACGGCGCGACC<br>AGCACGGCTCTAAGCGTGCTGGCGATGCGCTCGCTTGGTTGCAGCAATATCGACTAC<br>CTGGTACCAAACCGTTTCGAAGACGGTTACGGCTTAAGCCCGGAAGTGGTCGATCAG<br>GCCCATGCCCGTGGCGCGCAGTTAATTGTCACGGTGGATAACGGTATTTCCTCCCAT<br>GCGGGGGTTGAGCACGCTCGCTCGTTGGGCATCCCGGTTATTGTTACCGATCACCAT<br>TTGCCAGGCGACACATTACCCGCAGCGGAAGCGATCATTAACCCTAACTTGCGCGAC<br>TGTAATTTCCCGTCGAAATCACTGGCAGGCGTGGGTGTGGCGTTTTATCTGATGCTGG<br>CGCTGCGCACCTTTTTGCGCGATCAGGGCTGGTTTGATGAGCGTAACATCGCAATTC<br>CTAACCTGGCAGAACTGCTGGATCTGGTCGCGCTGGGGACAGTGGCGACGTCGTG<br>CCGCTGGACGCTAATAATCGCATTCTGACCTGGCAGGGGATGAGTCGCATCCGAGCC<br>GGAAAGTGCCGTCCGGGGATTAAAGCGCTGCTTGAAGTGGCAAACCGTGATGCACAA<br>AAACTCGCCGCCAGCGATTTAGGTTTTGCGCTGGGGCACGTCTCAATGCTGCCGGA<br>CGACTGGACGATATGTCCGTCGGTGTGGCGCTGTTGTTGTGCGACAACATCGGCGAA<br>GCGCGCGTGCTGGCAAATGAACTCGATGCGCTAAACCAGACGCGAAAAGAGATCGAA<br>CAAGGAATGCAAATTGAAGCCCTGACCCTGTGCGAGAAACTGGAGCGCAGCCGTGAC<br>ACGCTACCCGGCGGGCTGGCAATGTATCACCCCGAATGGCATCAGGGCGTTGTCGG<br>TATTCTGGCTTCGCGCATCAAAGAGCGTTTTCACCGTCCGGTTATCGCGTTTGCGCCA<br>GCAGGTGACGGTACGCTGAAAGGTTCCGGTCGCTCCATTCAGGGGCTGCATATGCGT<br>GATGCGCTGGAGCGATTAGACACACTCTACCCTGGCATGATGCTGAAGTTTGGCGGT<br>CATGCGATGGCGGCGGGTTTGTCGCTGGAAGAGGATAAATTCAAACTCTTTCAACAAC<br>GGTTTGGCGAACTGGTTACTGAGTGGCTGGACCCTTCGCTATTGCAAGGCGAAGTGG<br>TATCAGACGGTCCGTTAAGCCCGGCCGAAATGACCATGGAAGTGGCGCAGCTGCTG<br>CGCGATGCTGGCCCGTGGGGCAGATGTTCCCGGAGCCGCTGTTTGACGGTCATTT<br>CCGTCTGCTGCAACAGCGGCTGGTGGGCGAACGTCATTTGAAGGTGATGGTCGAAC<br>CGGTCGGCGGCGGTCCACTGCTGGATGGTATTGCTTTTAATGTCGATACCGCCCTCT<br>GGCCGGATAACGGCGTGCGCGAAGTGCAACTGGCTTATAAGCTCGATATCAACGAGT<br>TTCGCGGCAACCGAGCGCTGCAAATTATCATCGACAATATCTGGCCAATTCTGCAGA<br>AAAGGCCGGCGGCCACGAAAAAGGCCGGCCAGGCAAAAAAGAAAAAGCACCA<br>CCACCACCACTGA | |
| 54 | MGSSHHHHHHSSGLVPRGSHMASMTGGQQMGRGS<u>MASRGVNKVILVGNLGQDPE<br>VRYMPNGGAVANITLATSESWRDKATGEMKEQTEWHRVVLFGKLAEVASEYLRK<br>GSQVYIEGQLRTRKWTDQSGQDRYTTEVVVNVGGTMQMLGGRGS</u> EFELRRQACG<br>RMSIYQEFVNKYSLSKTERFELIPQGKTLENIKARGLILDDEKRAKDYKKAKQI<br>IDKYHQFFIEEILSSVCISEDLLQNYSDVYFKLKKSDDDNLQKDEKSAKDTIKKQ<br>ISEYIKDSEKEKNLENQNLIDAKKGQESDLIEWLKQSKDNGIELFKANSDITDID<br>EALEIIKSFKGWTTYFKGEHENRKNVYSSNDIPTSIIYRIVDDNLPKFLENKAKY<br>ESLKDKAPEAINYEQIKKDLAEELTEDIDYKTSEVNQRVESLDEVFEIANENNYL<br>NQSGITKENTIIGGKEVNGENTKRKGINEYINLYSQQINDKTEKKYKMSVLEKQ<br>ILSDTESKSEVIDKLEDDSDVVTTMQSFYEQ1AAFKTVEEKSIKETLSELFDDLK<br>AQKLDLSKIYEKNDKSLTDESQQVFDDYSVIGTAVLEYITQQIAPKNEDNPSKK | Underlining indicates SSB-<br>Bold indicates FnCpf1-<br>Italics indicates RecJ |

TABLE 7-continued

| SEQ ID NO | Sequence | Description |
|---|---|---|
| | EQELIAKKTEKAKYLSLETIKLALEEENKHRDIDKQCRFEEILANFAAIPMIFDE<br>IAQNKDNLAQISIKYQNQGKKDLLQASAEDDVKAIKDELDQTNNELHKEKIFHI<br>SQSEDKANILDKDEHFYLVFEECYFELANIVPLYNKIRNYITQKPYSDEKFKLNE<br>ENSTLANGWDKNKEPDNTAILFIKDDKYYLGVMNKKNNKIFDDKAIKENKGE<br>GYKKIVYKLLPGANKMLPKVFFSAKSIKEYNPSEDILRIRNHSTHTKNGSPQKG<br>YEKFEENIEDCRKFIDEYKQSISKHPEWKDEGFRESDTQRYNSIDEFYREVENQG<br>YKLTFENISESYIDSVVNQGKLYLFQIYNKDFSAYSKGRPNLIITLYWKALFDER<br>NLQDVVYKENGEAELFYRKQSIPKKITHPAKEAIANKNKDNPKKESVFEYDLIK<br>DKRFTEDKEFFHCPITINEKSSGANKENDEINELLKEKANDVHILSIDRGERHLA<br>YYTLVDGKGNIIKQDTENIIGNDRMKTNYHDKLAAIEKDRDSARKDWKKINNI<br>KEMKEGYLSQVVHEIAKLVIEYNAIVVFEDLNEGFKRGREKVEKQVYQKLEK<br>MLIEKLNYLVEKDNEFDKTGGVERAYQLTAPFETFKKMGKQTGIIYYVPAGFT<br>SKICPVTGEVNQLYPKYESVSKSQEFFSKEDKICYNEDKGYFEFSFDYKNEGDK<br>AAKGKWTIASEGSRLINFRNSDKNHNWDTREVYPTKELEKELKDYSIEYGHGE<br>CIKAAICGESDKKFFAKETSVENTILQMRNSKTGTELDYLISPVADVNGNFEDSR<br>QAPKNMPQDADANGAYHIGLKGEMLLGRIKNNQEGKKENLVIKNEEYFEFVQ<br>NRNNQAAALDLQVKQQIQLRRREVDETADLPAELPPLLRRLYASRGVRSAQELERSVKG<br>MLPWQQLSGVEKAVEILYNAFREGTRIIVVGDFDADGATSTALSVLAMRSLGCSNIDYLVP<br>NRFEDGYGLSPEVVDQAHARGAQLIVTVDNGISSHAGVEHARSLGIPVIVTDHHLPGDTL<br>PAAPAIINPNLRDCNEPSKSLAGVGVAFYLAILALRTFLRDQGWFDERNIAIPNLAELLDLV<br>ALGTVADVVPLDANNRILTWQGMSRIRAGKCRPGIKALLEVANRDAQKLAASDLGFALG<br>PRLNAAGRLDDAISVGVALLLCDNIGEARVLANELDALNQTRKEIEQGAVIEALTLCEKLE<br>RSRDTLPGGLAAIYHPEWLIQGVVGILASRIKERFHRPVIAFAPAGDGTLKGSGRSIQGLH<br>AIRDALERLDTLYPGAIVILKFGGHAMAAGLSLEEDKFKLFQQRFGELVTEWLDPSLLQG<br>EVVSDGPLSPAEAITMEVAQLLRDAGPWGQAIFFPEPLFDGHFRLLQQRLVGERHLKVAIV<br>EPVGGGPLLDGIAENVDTALWPDNGVREVQLAYKLDINEFRGNRSLQIIIDNIWPILQKR<br>PAATKKAGQAKKKKHHHHHH | |
| 55 | ATGGGCAGCAGCCATCATCATCATCATCACAGCAGCGGCCTGGTGCCGCGCGGC<br>AGCCATATGGCTAGCATGACTGGTGGACAGCAAATGGGTCGCGGATCC<u>ATGGCT</u><br><u>AAAAAAGAAATGGTTGAATTTGATGAAGCTATCCATGGCGAAGACTTGGCTAA</u><br><u>ATTTATTAAGAAGCATCTGATCATAAACTGAAAATTTCCGGTTATAATGAACT</u><br><u>GATTAAAGATATTCGAATTCGTGCTAAAGATGAACTTGGCGTTGATGGTAAGAT</u><br><u>GTTTAATCGTCTATTAGCTTTGTATCATAAAGATAACCGTGATGTGTTTGAAGCT</u><br><u>GAAACTGAAGAGGTAGTTGAACTTTATGACACAGTTTTCTCTAAAGGATCCGAA</u><br>TTCGAGCTCCGTCGACAAGCTTGCGGCCGCATGTCAATTTATCAAGAATTTGT<br>TAATAAATATAGTTTAAGTAAAACTCTAAGATTTGAGTTAATCCCACAGGGT<br>AAAACACTTGAAAACATAAAAGCAAGAGGTTTGATTTTAGATGATGAGAAA<br>AGAGCTAAAGACTACAAAAAGGCTAAACAAATAATTGATAAATATCATCAG<br>TTTTTTATAGAGGAGATATTAAGTTCGGTTTGTATTAGCGAAGATTTATTAC<br>AAAACTATTCTGATGTTTATTTTAAACTTAAAAAGAGTGATGATGATAATCT<br>ACAAAAAGATTTTAAAAGTGCAAAAGATACGATAAAGAAACAAATATCTGA<br>ATATATAAAGGACTCAGAGAAATTTAAGAATTTGTTTAATCAAAACCTTATC<br>GATGCTAAAAAAGGGCAAGAGTCAGATTTAATTCTATGGCTAAAGCAATCT<br>AAGGATAATGGTATAGAACTATTTAAAGCCAATAGTGATATCACAGATATA<br>GATGAGGCGTTAGAATAATCAAATCTTTTAAAGGTTGGACAACTTATTTTA<br>AGGGTTTTCATGAAAATAGAAAAAATGTTTATAGTAGCAATGATATTCCTAC<br>ATCGTTATTATTTATAGGATAGTAGATGATAATTTGCCTAAATTTCTAGAAAAT<br>AAAGCTAAGTATGAGAGTTTAAAAGACAAAGCTCCAGAAGCTATAAACTAT<br>GAACAAATTAAAAAAGATTTGGCAGAAGAGCTAACCTTTGATATTGACTAC<br>AAAACATCTGAAGTTAATCAAAGAGTTTTTTCACTTGATGAAGTTTTTGAGA<br>TAGCAAACTTTAATAATTATCTAAATCAAAGTGGTATTACTAAATTTAATAC<br>TATTATTGGTGGTAAATTTGTAAATGGTGAAAATACAAAGAGAAAAGGTAT<br>AAATGAATATATAAATCTATACTCACAGCAAATAAATGATAAAACACTCAAA<br>AAATATAAAATGAGTGTTTTATTTAAGCAAATTTTAAGTGATACAGAATCTA<br>AATCTTTTGTAATTGATAAGTTAGAAGATGATAGTGATGTAGTTACAACGAT<br>GCAAAGTTTTTATGAGCAAATAGCAGCTTTTAAAACAGTAGAAGAAAAATC<br>TATTAAAGAAACACTATCTTTATTATTTGATGATTTAAAAGCTCAAAAACTT<br>GATTTGAGTAAAATTTATTTTAAAAATGATAAATCTCTTATCGATCTATCAC<br>AACAAGTTTTTGATGATTATAGTGTTATTGGTACAGCGGTACTAGAATATAT<br>AACTCAACAAATAGCACCTAAAAATCTTGATAACCCTAGTAAGAAAGAGCA<br>AGAATTAATAGCCAAAAAAACTGAAAAAGCAAAATACTTATCTCTAGAAAC<br>TATAAAGCTTGCCTTAGAAGAATTTAATAAGCATAGAGATATAGATAAACA<br>GTGTAGGTTTGAAGAAATACTTGCAAACTTTGCGGCTATTCCGATGATATT<br>TGATGAAATAGCTCAAAACAAAGACAATTTGGCACAGATATCTATCAAATA<br>TCAAAATCAAGGTAAAAAAGACCTACTTCAAGCTAGTGCGGAAGATGATGT<br>TAAAGCTATCAAGGATCTTTTAGATCAAACTAATAATCTCTTACATAAACTA<br>AAAATATTTCATATTAGTCAGTCAGAAGATAAGGCAAATATTTTAGACAAG<br>GATGAGCATTTTTATCTAGTATTTGAGGAGTGCTACTTTGAGCTAGCGAAT<br>ATAGTGCCTCTTTATAACAAAATTAGAAACTATATAACTCAAAAGCCATATA<br>GTGATGAGAAATTTAAGCTCAATTTTGAGAACTCGACTTTGGCTAATGGTT<br>GGGATAAAAATAAAGAGCCTGACAATACGGCAATTTTATTTATCAAAGATG<br>ATAAATATTATCTGGGTGTGATGAATAAGAAAAATAACAAATATTTGATG<br>ATAAAGCTATCAAAGAAAATAAAGGCGAGGGTATAAAAAAATTGTTTATA<br>AACTTTTACCTGGCGCAAATAAAATGTTACCTAAGGTTTTCTTTTCTGCTAA<br>ATCTATAAAATTTTATAATCCTAGTGAAGATATACTTAGAATAAGAAATCAT | Underlining indicates DSB-Bold indicates FnCpf1 |

TABLE 7-continued

| SEQ ID NO | Sequence | Description |
|---|---|---|
| | TCCACACATACAAAAAATGGTAGTCCTCAAAAAGGATATGAAAAATTTGAG<br>TTTAATATTGAAGATTGCCGAAAATTTATAGATTTTTATAAACAGTCTATAA<br>GTAAGCATCCGGAGTGGAAAGATTTTGGATTTAGATTTTCTGATACTCAAA<br>GATATAATTCTATAGATGAATTTTATAGAGAAGTTGAAAATCAAGGCTACA<br>AACTAACTTTTGAAAATATATCAGAGAGCTATATTGATAGCGTAGTTAATCA<br>GGGTAAATTGTACCTATTCCAAATCTATAATAAAGATTTTTCAGCTTATAGC<br>AAAGGGCGACCAAATCTACATACTTTATATTGGAAAGCGCTGTTTGATGAG<br>AGAAATCTTCAAGATGTGGTTTATAAGCTAAATGGTGAGGCAGAGCTTTTT<br>TATCGTAAACAATCAATACCTAAAAAAATCACTCACCCAGCTAAAGAGGCA<br>ATAGCTAATAAAAACAAAGATAATCCTAAAAAAGAGAGTGTTTTTGAATAT<br>GATTTAATCAAAGATAAACGCTTTACTGAAGATAAGTTTTTCTTTCACTGTC<br>CTATTACAATCAATTTTAAATCTAGTGGAGCTAATAAGTTAATGATGAAAT<br>CAATTTATTGCTAAAAGAAAAAGCAAATGATGTTCATATATTAAGTATAGAT<br>AGAGGTGAAAGACATTTAGCTTACTATACTTTGGTAGATGGTAAAGGCAAT<br>ATCATCAAACAAGATACTTTCAACATCATTGGTAATGATAGAATGAAAACAA<br>ACTACCATGATAAGCTTGCTGCAATAGAGAAAGATAGGGATTCAGCTAGGA<br>AAGACTGGAAAAAGATAAATAACATCAAAGAGATGAAAGAGGGCTATCTAT<br>CTCAGGTAGTTCATGAAATAGCTAAGCTAGTTATAGAGTATAATGCTATTG<br>TGGTTTTTGAGGATTTAAATTTTGGATTTAAAAGAGGGCGTTTCAAGGTAG<br>AGAAGCAGGTCTATCAAAAGTTAGAAAAAATGCTAATTGAGAAACTAAACT<br>ATCTAGTTTTCAAAGATAATGAGTTTGATAAAACTGGGGGAGTGCTTAGAG<br>CTTATCAGCTAACAGCACCTTTTGAGACTTTTAAAAAGATGGGTAAACAAA<br>CAGGTATTATCTACTATGTACCAGCTGGTTTTACTTCAAAAATTTGTCCTGT<br>AACTGGTTTTGTAAATCAGTTATATCCTAAGTATGAAAGTGTCAGCAAATCT<br>CAAGAGTTCTTTAGTAAGTTTGACAAGATTTGTTATAACCTTGATAAGGGCT<br>ATTTTGAGTTTAGTTTTGATTATAAAAACTTTGGTGACAAGGCTGCCAAAG<br>GCAAGTGGACTATAGCTAGCTTTGGGAGTAGATTGATTAACTTTAGAAATT<br>CAGATAAAAATCATAATTGGGATACTCGAGAAGTTTATCCAACTAAAGAGT<br>TGGAGAAATTGCTAAAAGATTATTCTATCGAATATGGGCATGGCAATGTA<br>TCAAAGCAGCTATTTGCGGTGAGAGCGACAAAAAGTTTTTTGCTAAGCTAA<br>CTAGTGTCCTAAATACTATCTTACAAATGCGTAACTCAAAACAGGTACTGA<br>GTTAGATTATCTAATTTCACCAGTAGCAGATGTAAATGGCAATTTCTTTGAT<br>TCGCGACAGGCGCCAAAAAATATGCCTCAAGATGCTGATGCCAATGGTGCT<br>TATCATATTGGGCTAAAAGGTCTGATGCTACTAGGTAGGATCAAAAATAAT<br>CAAGAGGGCAAAAAACTCAATTTGGTTATCAAAAATGAAGAGTATTTTGAG<br>TTCGTGCAGAATAGGAATAACCAAGCGGCCGCACTCGAGAAAGGCCGGCGG<br>CCACGAAAAAGGCCGGCCAGGCAAAAAAGAAAAAGTCGACACCACCACCACC<br>ACCACTGAGATCCGGCTGCTAA | |
| 56 | MGSSHHHHHHSSGLVPRGSHMASMTGGQQMGRGS<u>MAKKEMVEFDEAIHGEDLA</u><br><u>KFIKEASDHKLKISGYNELIKDIRIRAKDELGVDGKATFNRLLALYHKDNRDVFEAET</u><br><u>EEVVELYDTVFSKGSEFELRRQACGR</u>MSIYQEFVNKYSLSKTLRFELIPQGKTLE<br>NIKARGLILDDEKRAKDYKKAKQIIDKYHQFFIEEILSSVCISEDLLQNYSDVYF<br>KLKICSDDDNLQKDEKSAKDTIKKQISEYIKDSEKEKNLENQNLIDAKKGQESDL<br>ILWLKQSKDNGIELFKANSDITDIDEALEIIKSFKGWTTYFKGEHENRKNVYSSN<br>DIPTSHYRIVDDNLPKFLENKAKYESLKDKAPEAINYEQIKKDLAEELTEDIDYK<br>TSEVNQRVESLDEVFEIANENNYLNQSGITKENTIIGGKEVNGENTKRKGINEYI<br>NLYSQQINDKTIKKYKMSVLEKQILSDTESKSEVIDKLEDDSDVVTTMQSFYEQ<br>IAAFKTVEEKSIKETLSLLFDDLKAQKLDLSKIYEKNDKSLTDISQQVFDDYSVI<br>GTAVLEYITQQIAPKNLDNPSKKEQELIAKKTEKAKYLSLETIKLALEEENKHR<br>DIDKQCRFEEILANFAAIPMIFDEIAQNKDNLAQISIKYQNQGKKDLLQASAEDD<br>VKAIKDLLDQTNNLLHKLKIFHISQSEDKANILDKDEHFYLVFEECYFELANIVP<br>LYNKIRNYITQKPYSDEKFKLNFENSTLANGWDKNKEPDNTAILFIKDDKYYLG<br>VMNKKNNKIFDDKAIKENKGEGYKKIVYKLLPGANKMLPKVFFSAKSIKEYNP<br>SEDILRIRNHSTHTKNGSPQKGYEKFEENIEDCRKFIDEYKQSISKHPEWKDEGF<br>RESDTQRYNSIDEFYREVENQGYKLTFENISESYIDSVVNQGKLYLFQIYNKDFS<br>AYSKGRPNLIITLYWKALFDERNLQDVVYKLNGEAELFYRKQSIPKKITHPAKE<br>AIANKNKDNPKKESVFEYDLIKDKRFTEDKEFFHCPITINEKSSGANKENDEINL<br>LLKEKANDVHILSIDRGERHLAYYTLVDGKGNIIKQDTENIIGNDRMKTNYHD<br>KLAAIEKDRDSARKDWKKINNIKEMKEGYLSQVVHEIAKLVIEYNAIVVFEDLN<br>FGEKRGREKVEKQVYQKLEKMLIEKLNYLVEKDNEFDKTGGVLRAYQLTAPF<br>ETFKKNIGKQTGIIYYVPAGFTSKICPVTGEVNQLYPKYESVSKSQEFFSKEDKI<br>CYNEDKGYFEFSFDYKNEGDKAAKGKWTIASEGSRLINFRNSDKNHNWDTREV<br>YPTKELEKELKDYSIEYGHGECIKAAICGESDKKFFAKETSVENTILQMRNSKT<br>GTELDYLISPVADVNGNFEDSRQAPKNMPQDADANGAYHIGLKGEMLLGRIKN<br>NQEGKKLNLVIKNEEYFEFVQNRNNQAAALEKRPAATKKAGQAKKKKSTPPPPP<br>LRSGC | Underlining indicates DSB-Bold indicates FnCpf1 |

Example 24: Analysis of SITE-Seq Target Sites for CCR5, DHCR7

This example describes analysis of SITE-Seq target sites for CCR5 and DHCR7. Whole genome resequencing analysis was performed. Sample included: total 7 (control+6 experimental samples). Total reads were 4,577,161,000, approximately 90 Gb per sample. Mean coverage was 26.78-32.22×. Read length was 300 bp. Control info was HEK293 (human embryonic kidney 293 lineage). Sample information is shown in the table below.

TABLE 8

| Target | Sample | Harvest time after transfection | Sample | Chr | Target Start | Target End | sgRNA |
| --- | --- | --- | --- | --- | --- | --- | --- |
| control | Genomic DNA | 48 h | GFLAS_01 | | | | non |
| CCR5 | In house Cas9 | 48 h | GFLAS_02 | Ch3 | 46414123 | 4641462 | TGACATCAATTATTATCAT (SEQ ID NO: 91) |
| | Cas9-RecJ | 24 h | GFLAS_03 | Ch3 | 46414123 | 4641462 | TGACATCAATTATTATCAT (SEQ ID NO: 91) |
| | Cas9-RecJ | 48 h | GFLAS_04 | Ch3 | 46414123 | 4641462 | TGACATCAATTATTATCAT (SEQ ID NO: 91) |
| DHCR7 | In house Cas9 | 48 h | GFLAS_05 | Ch11 | 71155241 | 71155261 | GGAGGTGGACTGGTTTTCAC (SEQ ID NO: 92) |
| | Cas9-RecJ | 24 h | GFLAS_06 | Ch11 | 71155241 | 71155261 | GGAGGTGGACTGGTTTTCAC (SEQ ID NO: 92) |
| | Cas9-RecJ | 48 h | GFLAS_07 | Ch11 | 71155241 | 71155261 | GGAGGTGGACTGGTTTTCAC (SEQ ID NO: 92) |

Below are tables showing on/off target region INDEL (DHCR7). These tables depict the results of whole genome sequencing between Cas9 and Cas9-RecJ. Cas9 and Cas9-RecJ showed similar offtarget efficiencies. (A) Summary of on-target results for DHCR7 are shown in the below table. The number of on target deletions in DHCR7 were 5. Deletions varied in length from 2 to 24.

Summary of off-target results for DHCR7 are shown in the below table. The samples were harvested at 24 h and 48 h after lipofection. The number of off target deletions in DHCR7 was 8. The deletions were largely two bases in length but ranged from 2 bases to 13.

Shown below is a table of on-target results after whole genome sequencing. Two genes, CCR5 and DHCR7, were tested. Each cell line was harvested 24 h and 48 h after lipofection.

TABLE 9

| Target | Sample | Harvest time after transfection | seq ID | Chr | sgRNA | Genome editing efficiency (%) |
| --- | --- | --- | --- | --- | --- | --- |
| non | Genomic DNA | 48 h | GFLAS_01 | | non | 0 |
| CCR5 | In house Cas9 | 48 h | GFLAS_02 | Ch3 | TGACATCAATTATTATACAT (SEQ ID NO: 91) | 0 |

TABLE 9-continued

| Target | Sample | Harvest time after trans- fection | seq ID | Chr | sgRNA | Genome editing efficiency (%) |
|---|---|---|---|---|---|---|
| | Cas9-RecJ | 24 h | GFLAS_03 | Ch3 | TGACATCAATTATT ATACAT (SEQ ID NO: 91) | 0 |
| | Cas9-RecJ | 48 h | GFLAS_04 | Ch3 | TGACATCAATTATT ATACAT (SEQ ID NO: 91) | 0 |
| DHCR7 | In house Cas9 | 48 h | GFLAS_05 | Ch11 | GGAGGTGGACTGG TTTTCAC (SEQ ID NO: 92) | 3.7 |
| | Cas9-RecJ | 24 h | GFLAS_06 | Ch11 | GGAGGTGGACTGG TTTTCAC (SEQ ID NO: 92) | 12.8 |
| | Cas9-RecJ | 48 h | GFLAS_07 | Ch11 | GGAGGTGGACTGG TTTTCAC (SEQ ID NO: 92) | 10.0 |

Amplicon Setup. Working on ice, primers were added using a multichannel pipette: 4 µl from VERTICAL i5(S5XX) primer strip was added to the COLUMNS of plate. 4 µl from HORIZONTAL i7(N7XX) primer strip was added to the ROWS of plate. Multichannel from polymerase 8-well strip 10 µl of polymerase into each well. Multichannel from DNA plate, 2 ul of 0.5 ng/µl DNA into corresponding wells. Seal plate, vortex, and spin in a plate centrifuge (2 mins at 2000 g). Proceed with PCR cycling conditions as follows. A qPCR (standard PCR can also be used) machine was used with KAPA HiFi mix for PCR as it contains SYBR green and is therefore possible to monitor how each sample is amplifying in real time. Cycling conditions are shown in the table below.

TABLE 10

| | Temperature | Time | Cycles |
|---|---|---|---|
| Denaturation | 98 | 2 mins | 1X |
| Denaturation | 98 | 30 | |
| Annealing | 60 | 30 | 10-12 cycles |
| Extension | 72 | 30 | |
| Final | 72 | 5 mins | 1X |
| Hold | 4 | | |

Clean second round PCR products as follows. 30 µl of H2O was added to each well of the PCR plate to bring the total volume per well to 50 µl. 50 µl of AmpureXP beads was added to each well of a 96-well round bottom plate. 50 µl of PCR product was transferred to the 96-well plate containing 50 µl AmpureXP mix and pipette up and down 10× to mix. Samples were incubated at least 10 mins on bench. Plate were placed on 96-well plate magnet for 5 mins (make sure liquid appears clear). Supernatant was discarded by pipette/aspirate. Samples were washed by adding 190 µl of 70-80%. Ethanol to each sample and wait 30 seconds. Ethanol was discarded by pipette/aspirate. Prior two steps were repeated for a total of two washes. Plates were removed from magnet and allow to air dry for 2-3 mins—make sure you cannot detect any ethanol. Plates were taken off the magnet and resuspend the beads in 22 µl of H2O, pipetting up and down 10× to mix thoroughly. Samples were incubated for at least 10 mins on bench. Plate was placed back on the magnet 5 mins (make sure liquid appears clear). 20 µl of the supernatant was transferred to a new 96-well PCR plate.

PCR products were pooled and the library was quantified as follows. 10 µl of each second round PCR product was transferred from plate into a single microcentrifuge tube. Concentration of DNA was determined using the Qubit. DNA concentration was adjusted to 2 nM. MiSeq protocols were followed for sequencing.

FIG. 20B shows the results of off-target effects by amplicon deep sequencing for human CCR5. Cas9 was compared to Cas9 RecJ. Five human CCR5 off-targets were tested in this study. Shown below is a table of the CCR5 off-target candidate sequences. Underlined letters stand for single polymorphism. FIG. 13O illustrates a schematic depicting cell-based validation for each experiment. The on-target sequence was shown at the top of the alignment, mismatched nucleotides are highlighted.

TABLE 11

| Target | Gene | Spacer sequence | SEQ ID NO: |
|---|---|---|---|
| On | CCR5 | TGACATCAATTATTATACAT | 91 |
| Off #1 | ADCY5 | TGACATCAATTATTATAgAT | 93 |
| Off #2 | KCNJ6 | TGACATCAcTTATTATgCAT | 94 |
| Off #3 | CNTNAP2 | TGACATaAATTATTcTACAT | 95 |
| Off #4 | Chr.5 N/A | TGAaATCAATTATcATAgAT | 96 |

The table below shows off-target effects by amplicon deep sequencing. The results of amplicon deep sequencing between Cas9 and Cas9-RecJ. Cas9-RecJ had lower off targeting efficiency for three regions, KCNJ6, CNTPNA2, and Ch.5 except ADCY5. The samples were harvested at 48 h after electroporation.

TABLE 12

| | Cas9 | | Cas9-RecJ | |
|---|---|---|---|---|
| off-targets of CCR5 | reads (372,767) | percent (%) | reads (406,009) | percent (%) |
| ADCY5 | 269 | 0.0007 | 1009 | 0.0025 |
| KCNJ6 | 339 | 0.0009 | 254 | 0.0006 |
| CNTPNA2 | 624 | 0.0017 | 437 | 0.0011 |
| Ch.5 | 601 | 0.0016 | 573 | 0.0014 |

Based on whole genome sequencing, there were no significant values of off-target effect detected between Cas9 and Cas9-RecJ treatment. Cas9-RecJ had lower off-targeting efficiency for three regions, KCNJ6, CNTPNA2, and Ch.5 except ADCY5 in amplicon deep sequencing.

Example 25: CRISPR PLUS™ in Plants

This example describes use of the fusion constructs disclosed herein in plants.

Plant growth condition and protoplast transfection. All plants were grown under 150 E m$^{-2}$ s$^{-1}$ LED light under long-day (14-h light/10-h dark photoperiod) condition at 25° C. Rice seeds were sterilized in 20% hypochlorite solution for 40 min, and then placed on ½ MS media. The one-week-old leaves were used in this study. Tobacco (*Nicotiana benthamiana*) seeds were sterilized in a 20% hypochlorite solution for 1 min, washed three times in distilled water, and sown on 0.5× Gamborg B5 solid medium supplemented with 2% sucrose. The 4-week-old leaves grown in B5 media were digested with enzymes (1.5% cellulose R10, 0.3% macerozyme R10, 0.5 M Mannitol, 8 mM CaCl2, 5 mM MES [pH 5.7], 0.1% BSA) for 4 h at 25° C. in darkness. The mixture was filtered before protoplasts were collected by centrifugation at 100 g in a round-bottomed tube for 6 min. Re-suspended protoplasts were washed with W5 (154 mM NaCl, 125 mM CaCl$_2$.2H$_2$O, 5 mM KCl, 2 mM MES [pH5.7]) solution and pelleted by centrifugation at 100 g for 6 min. Finally, protoplasts were re-suspended in MMG (0.4 M mannitol, 15 mM MgCl$_2$, 4 mM MES [pH 5.7]) solution and counted under the microscope using a hemocytometer. Protoplasts were diluted to a density of 1×10$^6$ protoplasts/ml of MMG solution and stabilized at least for 30 min at 4° C. before PEG-mediated transfection.

2×10$^5$ protoplast cells were transfected with Cas9 protein (10 µg) pre-mixed with in vitro-transcribed sgRNA (20 µg). Prior to transfection, Cas9 protein was mixed with sgRNA in 1×NEB buffer 3 and incubated for 10 min at room temperature. A mixture of protoplasts re-suspended in 200 µl MMG solution was gently mixed with 10-20 µl of RNP complex and 210-220 µl of freshly prepared PEG (0.2 M mannitol, 40% W/V PEG-4000, 100 mM CaCl2) solution and then incubate at 25° C. for 15 min. After a 15 min incubation at room temperature, transformation was stopped by 840-880 µl adding W5 solution. Protoplasts were then collected by centrifuging for 2 min at 100 g at room temperature and washed one more time with 1 ml of wash buffer by centrifuging for another 2 min at 100 g. The density of protoplasts was adjusted to 1×10$^5$/ml, and they were cultured in modified PIM (B5 medium 1.58 g, sucrose 103 g, 2,4-D 0.2 mg, BAP 0.3 mg, MES 0.1 g, CaCl$_2$.2H$_2$O 375 mg, NaFe-EDTA 18.35 mg and Sodium succinate 270 mg) medium.

Amplicon deep sequencing was carried out as described in EXAMPLE 24. Used primer sequences were FucT13_1FUT1F1_
(SEQ ID NO: 97)
5'-TCGTCGGCAGCGTCAGATGTGTATAAGAGACAGGCATTTGGTGTAGG
TTTAGGCT-3', FucT13_1FUT1R1_
(SEQ ID NO: 98)
5'-GTCTCGTGGGCTCGGAGATGTGTATAAGAGACAGAATTCTGAAAATC
CAAGTCTAT-3', FucT13_1FUT3F1_
(SEQ ID NO: 99)
5'-TCGTCGGCAGCGTCAGATGTGTATAAGAGACAGACTTCTCTTGGGCTG
AGTATGA-3', FucT13_1FUT3R1_
(SEQ ID NO: 100)
5'-GTCTCGTGGGCTCGGAGATGTGTATAAGAGACAGCAGTAAGTTTGGAT
ATTTGAAA-3'.

FIG. 64 illustrates gene editing efficiency in rice protoplasts. Each Cas9 variant and the same guide RNA against the same loci of rice Dwarf5 were transfected to protoplasts of 1-week-old rice. Rice protoplasts using PEG or lipid mediated transfection method. Cells were harvested at 48 hour after transfection for genomic DNA extraction. In order to improve discriminability of cut DNA band, alternative PCR primer pair was used and that resulted in clearer single whose sizes, which were subjected to T7E1 assay and SpyCas9/sgRNA. SpyCas9/sgRNA. sgRNA sequence is TCAACCACCCTGTGAATTT (SEQ ID NO: 57). Primer pairs for PCR are F1, GGATTGGATTGGTATTGTCGT (SEQ ID NO: 58); R1, TCACTTTTGATGAACTAT (SEQ ID NO: 59)

FIG. 131 illustrates gene editing efficiency in *N. benthamiana* protoplasts. Each Cas9 variant and the same guide RNA against the same loci of *N. benthamiana* fucT13_1 were transfected to protoplasts of 4-week-old leaves of *N. benthamiana*. The protoplasts using PEG-mediated transfection method. Cells were harvested at 24 h, 48, and 72 h after transfection, and then genomic DNA was extraction. In order to improve discriminability of cut DNA band, alternative PCR primer pair was used for clearer single whose sizes, which were subjected to in vitro cleavage assay with SpyCas9/sgRNA. sgRNA sequence is CAAGGGCTTCTAAAGCTTGCAAA (SEQ ID NO: 60). Primer pairs for PCR are F1, GCAGAATTAGTTGAGCGC-CACCAGATA (SEQ ID NO: 61); R1, GTGCAAAACAACAGCAAAAGAAGA-TAACAATAACAATAAC (SEQ ID NO: 62).

The table below shows amount of gRNA and protein used in the generation of each RNP complex.

TABLE 13

| | RNP complex | |
|---|---|---|
| gRNA | PFT3 (10 µg) | PFT3 (10 µg) |
| | PFT1 (10 µg) | PFT1 (10 µg) |
| Protein | SpyCas9 (20 µg) | SpyCas9:RecJ (26 µg) |

FIG. 136 illustrates gene editing efficiency in *N. benthamiana* protoplasts. Each Cas9 variant and the same guide RNA against the same loci of *N. benthamiana* FucT13_1 and NbFucT13_3 were transfected to protoplasts of 4-week-old leaves of *N. benthamiana*. The protoplasts using PEG-mediated transfection method. Cells were harvested at 48 h after transfection, and then genomic DNA was extraction. Cas9-RecJ had 2-3 fold higher genome editing efficiency than Cas9 alone. Black boxes, negative control; blue boxes, Cas9 applied samples; orange boxes, Cas9-RecJ applied samples. Shown below in tables are the values that were extracted from targeted deep sequencing.

TABLE 14

| Conditions | Samples | Total Sequences | With both indicator sequences | More than frequency | Insertions | Deletions | | Indel frequency | Indel frequency (%) |
|---|---|---|---|---|---|---|---|---|---|
| 13_1 PFT3 | con | 108344 | 107309 | 102874 | 3 | 449 | 452 | (0.4%) | 0.4 |
| | Cas9 | 80766 | 80073 | 76594 | 279 | 574 | 853 | (1.1%) | 1.1 |
| | Cas9 | 73419 | 72721 | 69201 | 879 | 924 | 1803 | (2.6%) | 2.6 |
| | Cas9 | 95494 | 94584 | 90408 | 629 | 1353 | 1982 | (2.2%) | 2.2 |
| | Cas9:RecJ | 102906 | 101894 | 97056 | 2315 | 2601 | 4916 | (5.1%) | 5.1 |
| | Cas9:RecJ | 125519 | 124292 | 118522 | 3190 | 3504 | 6694 | (5.6%) | 5.6 |
| | Cas9:RecJ | 102660 | 101069 | 94971 | 7330 | 9381 | 16711 | (17.6%) | 17.6 |

TABLE 15

| 13_1 PFT1 | con | 196230 | 144327 | 138573 | 7 | 472 | 479 | (0.3%) | 0.3 |
|---|---|---|---|---|---|---|---|---|---|
| | Cas9 | 125076 | 79885 | 75976 | 822 | 1190 | 2012 | (2.6%) | 2.6 |
| | Cas9 | 38597 | 21658 | 20137 | 711 | 571 | 1282 | (6.4%) | 6.4 |
| | Cas9:RecJ | 227861 | 160703 | 153332 | 7741 | 6873 | 14614 | (9.5%) | 9.5 |
| | Cas9:RecJ | 198048 | 152119 | 144225 | 11924 | 8799 | 20723 | (14.4%) | 14.4 |

Results showed that Cas9-RecJ showed about 5%-40% higher genome editing efficiencies than Cas9 protein in rice and *N. benthamiana*.

Example 26: Evaluation of Zinc Sulfate Treatment

This example describes evaluation of zinc sulfate treatment.

Cell culture. HEK 293 cells were maintained in DMEM media with 10% Fetal bovine serum FBS and P/S, at 37° C. in $CO_2$ incubator. 150,000 cells were transferred to a 24 well plate in 50 ml of the growth medium a day before transfection.

Transfection. For Cas9 variants transfection to the cells, purified each Cas9 variant protein was added to up to 25 ml of Opti-MEM serum reduced medium in a micro tube, followed by addition of 120 ng guide RNA. The molar ratio of the guide RNA to Cas9 protein was kept nearly at 1.2:1 ratio(1). The mixture, then, mixed well by gentle tapping and incubated for 10 min at RT. In a separate tube. 2 ml of Lipofectamin 3000 transfection reagent was added to 25 ml of Opti-MEM and 25 ml of the diluted transfection reagent was added to the guide RNA and Cas9 protein mixture, followed by incubation for 15 min at RT and 50 ml mixture was added to the cells.

Genomic DNA extraction. Genomic DNA extraction was performed using PureLink Genomic DNA kits following the manufacture's instruction. Briefly cells were washed with PBS once and treated with T.E., followed by incubation at 37, for 5 min. 1.2 ml of growth media were added to cells to harvest cell and then, spin downed at RT, 250×g, for 5 min.

Amplification of genomic loci of human DHCR7. For amplification of genomic loci of human DHCR7, two different PCR primer pairs were used. Forward primer 1: 5'-CAGTAGAGCAGGCATGTTGAGT-3' (SEQ ID NO: 101); Reverse primer 1: 5'-GTGAAGGTGTAT-CAAACGCTGA-3' (SEQ ID NO: 102), which those pair results in two fragments of cut DNA bands whose sizes are 427 and 205, respectively, after T7E1 assay, while only single cut DNA fragment is produced when using following alternative primer pair:

Forward primer 2:
(SEQ ID NO: 103)
5'-GGGAAACCACTGGCCTTGG-3';

Reverse Primer 2:
(SEQ ID NO: 104)
5'-GAGCCAGGATCCATGTCCCA-3'.

T7E1 assay. Genomic DNA was amplified using specific primers and cleaned up using Wizard® SV gel and PCR clean-Up system. 200 ng PCR cleaned-up amplified DNA was added in a PCR-tube, followed by addition of 1 ml of NEB buffer 2 with up to 9 ml of distilled water (D/W). The mixture was then re-annealed in a PCR machine using following condition: 98° C. for 5 min for denaturation; cooling down to 85° C. at −2° C./sec, in turn, to 25° C. at −0.1/sec and kept at 4° C., in order to prevent denaturation of heteroduplex formation of the amplified DNA. 1 ml of T7E1 endonuclease was added to the mixture and incubated at 37° C. for 60 min.

Image Analysis. For analysis of gene modification, 2% gel was used image was obtained with and Alphaimager 2200 image analysis software was used for analysis. % indel was computed with following equation: 1−((1-fraction cleaved) ½)(2).

FIG. 132 shows a for zinc sulfate treatment. HEK293 cells were harvested at 12 h, 24 h, and 48 h after zinc sulfate treatment. In terms of RNP treatment, HEK293 cells were harvested at 24 h, 36 h, and 60 h. FIG. 133 shows HEK293 cell images along with gradual zinc sulfate concentration. The concentration of 0 to 120 mM 160 mM of zinc sulfate allowed HEK293 cell to survive, whereas 160 mM and 200 mM zinc sulfate treatments did not allow HEK293 live well without toxicity effect. FIG. 134 shows in vitro cleavage assay after zinc sulfate treatment. The concentration of 80 mM 160 mM of zinc sulfate were treated in HEK293 with Cas9 variants. HEK293 cells were harvested at 12 h, 24 h, and 48 h after zinc sulfate treatment. In terms of RNP treatment, HEK293 cells were harvested at 24 h, 36 h, and 60 h. The genome editing efficacy was reduced after zinc sulfate treatment. FIG. 135 shows in vitro cleavage assay after zinc sulfate treatment. The concentration of 80 mM 160 mM of zinc sulfate were treated in HEK293 with Cas9 variants. HEK293 cells were harvested at 12 h, 24 h, and 48 h after zinc sulfate treatment. In terms of RNP treatment, HEK293 cells were harvested at 24 h, 36 h, and 60 h. Top right panel showed the results when media exchanged. The genome editing efficacy was reduced after zinc sulfate treatment.

Example 27: Evaluation of SSB-SpyCas9 and DSB-SpyCas9

This example demonstrates an evaluation of SSB-SpyCas9 and DSB-SpyCas9.

SSB-SpyCas9 method (in vitro). Single stranded binding protein (SSB) fused to SpyCas9 was heterogeneously expressed in E. coli. In order to know its binding affinity, purified SSB-SpyCas9 protein was incubated with ssODNs, which were synthesized in commercial custom DNA oligonucleotide synthesis company. The used DNA oligos, 30mer is donor_NcoI_F1_5'-CAGGGAGGTGGACTGGTTTTC-CATGGCGAG-3' (SEQ ID NO: 105) and 130mer is donor_NcoI_F3_5'-CTCT-TAGGGTCCTGGTGGGGCCCAGGGCA-GATGGGCCCCAGTGTGACTGCCTGCAT CCGTCCTCGCAGGGAGGTGGACTGGTTTTC-CATGGCGAGCGTCATCTTCCTACTGCT GTTCGCCCCCTTCATCG-3' (SEQ ID NO: 106). SSB-SpyCas9 protein amount was used by increasing gradually from 1 µg to 4 µg with 2.5 µg of ssODNs, which used two different sizes, 30 nt and 130 nt, respectively. For 10 min incubation, and then the reaction mixtures were subjected to electrophoresis.

DSB-SpyCas9 method (in vitro). Double stranded binding protein (DSB) fused to SpyCas9 was heterogeneously expressed in E. coli. In order to know its binding affinity, purified DSB-SpyCas9 protein was incubated with dsDNA, which were synthesized in commercial custom DNA oligonucleotide synthesis company. The used DNA oligos, 253mer is 5'-TCGTCGGCAGCGTCA-GATGTGTATAAGAGACAGGGTATTTCTGTTCAGAT-CACTAA ACTCAAGAATCAGCAATTCTCT-GAGGCTTTCTTTTAAATATACATAAGGAACTTTCG GAGTGAAGGGAGAGTTTGTCAATAACTTGATG-CATGTGAAGGGGAGATAAAAAGG TTGCTATTTTT-CATCAACATATTTTGATTTGGCTTTCTATAATT-GATGGGCCTGTCTC TTATACACATCTCCGAGCCCACGAGAC-3' (SEQ ID NO: 107). DSB-SpyCas9 protein amount was used by decreasing gradually from 7 µg to 7 ng with 50 ng of dsDNA. For 30 min incubation, and then the reaction mixtures were subjected to electrophoresis.

FIG. 137 illustrates binding affinity measurement between SSB-SpyCas9 protein and single stranded oligonucleotides (ssODN). SSB-SpyCas9 protein was tested to bind to ssODN in vitro condition. SSB-SpyCas9 protein amount was used with increasing gradually from 1 µg to 4 µg with 2.5 µg of ssODNs, which used two different sizes, 30 nt and 130 nt, respectively. For 10 min incubation, and then the reaction mixtures were subjected to electrophoresis. The ssODN intensities decreased by 30% along with increase of SSB-SpyCas9 protein dose. This result indicates that ssODN forms complex with SSB-SpyCas9 protein. FIG. 138 illustrates binding affinity measurement between DSB-SpyCas9 protein and double stranded DNA (dsDNA). DSB-SpyCas9 protein was tested to bind to dsDNA in vitro condition. DSB-SpyCas9 protein amount was used with decreasing gradually from 7 µg to 7 ng with 50 ng of dsDNA (253 bp). The dsDNA intensities decreased along with increase of DSB-SpyCas9 protein dose. Decreased intensity of free DNA suggest that DNA forms complex with DSB-SpyCas9 proteins. Band designations: F, free DNA; B, protein-DNA complex FIG. 139 illustrates a comparison of knock-out and knock-in efficiencies among SpyCas9, DSB-SpyCas9, and DSB-SpyCas9-RecJ. SpyCas9, DSB-SpyCas9, and DSB-SpyCas9-RecJ show different genome editing efficiency. FIG. 140 illustrates a comparison of knock-out efficiencies between SpyCas9 and DSB-SpyCas9. (A) Schematic of DSB-SpyCas9 construct. (B) Editing efficiency at SpyCas9 and DSB-SpyCas9 treatment with addition of dsDNA and nocodazole. (C) Percent change in efficiency of DSB-SpyCas9 over SpyCas9. FIG. 141 illustrates a comparison of knock-in efficiencies between SpyCas9 and DSB-SpyCas9. (A) Schematic of DSB-SpyCas9 construct. (B) Editing efficiency at SpyCas9 and DSB-SpyCas9 treatment. (C) Percent change in efficiency of DSB-SpyCas9 over SpyCas9.

In vitro transfection and deep sequencing analysis of on-target sites was performed. For cell culture, HEK293T cells were cultured in Dulbecco's modified Eagle's medium (DMEM) supplemented with 10% fetal bovine serum, penicillin, and streptomycin. For cell cycle synchronization, for improving efficiency of knock-in, HEK293T cells were seeded at $3 \times 10^6$ cell density in 10-cm culture dish. The cells were treated with nocodazole (200 ng/ml) for 16 hours before electroporation. dsDNA donors for knock-in (table) are listed below.

TABLE 16

| Proteins | Genes | dsDNA (5'-3') |
|---|---|---|
| SpyCas9 | CCR5 | GAGACCCTGTCTCACAACAACAACAACAACAAAAAGGCTGAGCT GCACCATGCTTGACCCAGTTTCTTAAAATTGTTGTCAAAGCTTCATTCA CTCCATGGTGCTATAGAGCACAAGATTTTATTTGGTGAGATGGTGCTT TCATGAATTCCCCCAACAGAGCCAAGCTCTCCATCTAGTGGACAGGGA AGCTAGCAGCAAACCTTCCCTTCACTACAAAACTTCATTGCTTGGCCA AAAAGAGAGTTAATTCAATGTAGACATCTATGTAGGCAATTAAAAAC CTATTGATGTATAAAACAGTTTGCATTCATGGAGGGCAACTAAATACA TTCTAGGACTTTATAAAAGATCACTTTTTATTTATGCACAGGGTGGAA CAAGATGGATTATCAAGTGTCAAGTCCAATCTATGACATCAATTATTA TACACATATGTCGGAGCCCTGCCAAAAAATCAATGTGAAGCAAATCG CAGCCCGCCTCCTGCCTCCGCTCTACTCACTGGTGTTCATCTTTGGTTT TGTGGGCAACATGCTGGTCATCCTCATCCTGATAAACTGCAAAAGGCT GAAGAGCATGACTGACATCTACCTGCTCAACCTGGCCATCTCTGACCT GTTTTTCCTTCTTACTGTCCCCTTCTGGGCTCACTATGCTGCCGCCCAG TGGGACTTTGGAAATACAATGTGTCAACTCTTGACAGGGCTCTATTTT ATAGGCTTCTTCTCTGGAATCTTCTTCATCATCCTCCTGACAATCGATA GGTACCTGGCTGTCGTCCATGCTGTGTTTGCTTTAAAAGCCAGGACGG TCACCTTTGGGGTGGTGACAAGTGTGATCACTTGGGTGGTGGCTGTGT TTGCGTCTCTCCCAGGAATCATCTTTACCAGATCTCAAAAAGAAGGTC |

TABLE 16-continued

| Proteins | Genes | dsDNA (5'-3') |
|---|---|---|
| | DHCR7 | TTCATTACACCTGCAGC (SEQ ID NO: 108)<br>CTTTCCAGCCTTTGGAATTGTATGGACCCAAAGGAATGAAGGACCTTT<br>TTAAAAAAGATTTTTTTTTTTTGTCAAGACTAATGAAAGGTAAACAG<br>TTTTCCACTTTATAAAGTAAGGAATTATAAAAAGAAACTAGAAATCAT<br>GGTCAGTCAACAACTTAGAAAAAAAGATAAAGGCTTAAAGGGCAGCT<br>GGGGCCTTCCCACCATCTGGGGTATGACCTATTGTCACAGCTCCCAT<br>TTCGCCATAGAACCATGGGGACTTCGTGCAGGGTGAGTATCCTCTCCG<br>ACCTGGAACTGGGGAAACCACTGGCCTTGGTGGTTGTGAAAGACCTAC<br>CTCCGCTCATATTCTGAGCTCTGGGCCTTCCATGGGGGCCACAGATAG<br>TGCCACCAGTTAATCAACTACAGTAGAGCAGGCATGTTGAGTGGCTTC<br>CCTGGCCGCAAGGAGGGCCCGTGCTAGGAGCTAATGCCTTCTGTCATG<br>GGGTACTGGTGGGTTTGAGCAACAGTTCTCCCACACAGAGCCTCTTAG<br>GGTCCTGGTGGGGCCCAGGGCAGATGGGCCCAGTGTGACTGCCTGC<br>ATCCGTCCTCGCAGGGAGGTGGACTGGTTTTGAATTCCACTGGCGAGC<br>GTCATCTTCCTACTGCTGTTCGCCCCCTTCATCGTCTACTACTTCATCAT<br>GGCTTGTGACCAGTACAGCTGCGCCCTGACTGGCCCTGTGGTGGACAT<br>CGTCACCGGACATGCTCGGCTCTCGGACATCTGGGCCAAGACTCCACC<br>TATAACGAGGAAAGCCGCCCAGCTCTATACCTTGTGGGTCACCTTCCA<br>GGTCAGCAGCCCCTGCCCTGGGGTTGGGACACAGCAGGTGGGGAGCG<br>TGCCCTCCTGCTGGGGTAGTCCTTCCATTTGTCTGGGACATGGATCCTG<br>GCTCAGGTTGACATCTGGGTTCCCGGGACCCAGCAGGGCATTCCCTGG<br>ACTCTGACATGTTCAGATTCATCCTCAGCTGTAAGGCAGGAGGCACCT<br>GTCACATCAGCGTTTGATACACCTTCACGGCATGCCTGCATGCAGTTG<br>CTGGGCACGCCCAGCTCTGCAGGGACAAGCTGAGGATAGGAGCAAAA<br>CCCCGTGGGAGGGCAGTGCTGTCCTGAGGAAGCCCCATTGTCAGCAG<br>GAGTCACGCCTTGCACCAGGTCTGGAAAGGAGCATCTCAGTCCCCAAA<br>GGGAC (SEQ ID NO: 109) |

In vitro transfection and deep sequencing analysis of on-targets sites was performed.

RNP preparation and electroporation. Before transfection to the cells, purified each SpyCas9, DSB-SpyCasa9, and DSB-SpyCas9-RecJ protein (33 pmol) and sgRNA (66 pmol) were incubated at RT for 20 minutes for RNP complex. 2 pmol dsDNA was then added to RNP complex. Nucleofection of HEK293T cells was performed using Lonza. Each nucleofection reaction consisted of approximately $2\times10^5$ cells in 20 µl of nucleofection reagent and mixed with 10 µl of RNP:DNA.

Genomic DNA extraction. Genomic DNA extraction was performed using PureLink Genomic DNA kits following the manufacture's instruction.

Deep sequencing analysis of on-target sites. The genomic region flanking the target site for each gene was amplified by following PCR method. First, the genomic DNA from the edited and control samples was isolated and PCR amplified 35 cycles using Q5 High-fidelity DNA polymerase with Pt PCR primers to prevent capture donor DNA. Then, PCR products were further amplified using 2nd adapter primers. The resulting amplicons were QIAquick PCR Purification kit. These samples were subjected to eight cycles of PCR using KAPA HotStart DNA Polymerase for indexing, followed by AMPure bead purification. Purified DNA samples were quantified by Qubit 2.0 Fluorometer, size analyzed by BioAnalyzer, and pooled in an equimolar ratio. Sequencing libraries were sequenced with the Illumina MiniSeq. Data was analyzed using Cas-Analyzer program.

TABLE 17

| Proteins | Genes | PCR round | Primer sequences (5'-3') |
|---|---|---|---|
| SpCas9 | CCR5 | 1st | GATGCTTAGAACAGTGATTGG (SEQ ID NO: 110) |
| | | | CCAAAGAATTCCTGGAAGGTG (SEQ ID NO: 111) |
| | | 2nd | TCGTCGGCAGCGTCAGATGTGTATAAGAGACAGGGAGG<br>GCAACTAAATACATTCT (SEQ ID NO: 83) |
| | | | GTCTCGTGGGCTCGGAGATGTGTATAAGAGACAGGAACA<br>CCAGTGAGTAGAGCGG (SEQ ID NO: 84) |
| | DHCR7 | 1st | GGAAAGGTGGTGTCTGTTATTTGAGGG (SEQ ID NO: 112) |
| | | | CCTGTCTCTTTCTAGCACCGTTTCC (SEQ ID NO: 113) |
| | | 2nd | TCGTCGGCAGCGTCAGATGTGTATAAGAGACAGGGTTTG<br>AGCAACAGTTCTCC (SEQ ID NO: 85) |
| | | | GTCTCGTGGGCTCGGAGATGTGTATAAGAGACAGTGACG<br>ATGTCCACCACAG (SEQ ID NO: 86) |

Example 28: In Vivo Transfection and Analysis of HDR by EcoRI Restriction Digestion This example describes in vivo transfection and analysis of HDR by EcoRI restriction digestion. Cell culture. HEK293T cells are cultured in Dulbecco's modified Eagle's medium (DMEM) supplemented with 10% fetal bovine serum, penicillin, and streptomycin.

RNP preparation and electroporation. Before transfection to the cells, purified SpyCas9, SSB-SpyCas9, and SSB-SpyCas9-RecJ protein (33 pmol) and DHCR7 sgRNA (66 pmol) are incubated at RT for 20 minutes for RNP complex. 2 or 20 pmols of 56 mer ssODN (CCTCGCAGG-GAGGTGGACTGGTTTTGAATTCCACTGGCGAGCGT-CATCTTCCTACT (SEQ ID NO: 63)) are then added to RNP complex. Nucleofection of HEK293T cells is performed using Lonza. Each nucleofection reaction consists of approximately $2\times10^5$ cells in 20 µl of nucleofection reagent and is mixed with 10 µl of RNP:DNA.

Genomic DNA extraction. Genomic DNA extraction is performed using PureLink Genomic DNA kits following the manufacture's instruction.

PCR amplification of target region. A 1633 nt region of DHCR7 loci, containing the target site, is PCR amplified using the following primer set. Then, 2nd PCR is performed using $1^{st}$ PCR product as a template. Primers are listed below. The resulting amplicons are purified using QIAquick PCR Purification kit. The PCR products are analyzed on 1% agarose gel.

TABLE 18

| Gene | PCR round | | Primer sequences (5'-3') |
|---|---|---|---|
| DHCR7 | 1st | Forward | GGAAAGGTGGTGTCTGTTATTTGAGGG (SEQ ID NO: 112) |
| | | Reverse | CCTGTCTCTTTCTAGCACCGTTTCC (SEQ ID NO: 113) |
| | 2nd | Forward | GGGAAACCACTGGCCTTGG (SEQ ID NO: 103) |
| | | Reverse | GAGCCAGGATCCATGTCCCA (SEQ ID NO: 104) |

Analysis of HDR by EcoRI restriction digestion. EcoRI directly cleaves PCR DNA containing the newly integrated EcoRI restriction sequence to detect successful HDR. The reaction contains 10 ug of PCR products and 10 units of EcoRI in CutSmart buffer. After 2 hours of enzyme digestion at 37° C., the product is resolved on 2% agarose gel. The percentage of HDR is calculated using ImageJ.

HDR is enhanced through the single stranded DNA binding (SSB) protein fusion to SpyCas9 at its N-terminus (SSB-SpyCas9). The SSB-SpyCas9 binds to the repair template ssODN. Ternary complex consisting of the ssODN, SSB-SpyCas9, and sgRNA may result in "Deliver to Repair" even with relatively tiny amount of the ssODN DNA. HDR occurs more efficiently than that of control group due to local availability of the ssODN, since SSB protein will bring ssODN at the place where double stand break occurs.

SEQUENCE LISTING (329 sequences)

SEQ ID NO: 1 - DNA, 4329 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagaaaaggccggcggccacgaaaaaggccggccaggcaaaaaagaaagagcaccaccaccaccaccactga

SEQ ID NO: 2 - protein, 1442 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEKRPAATKKAGQAKKKEHHHHHH

SEQ ID NO: 3 - DNA, 5049 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagatgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaactcgagaaaaggccggcggccacgaaaaaggccggccaggcaaaaaagaaaaagcaccaccaccaccaccactga

SEQ ID NO: 4 - protein, 1682 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEMSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKLEKRPAATKKAGQAKKKKHHHHHH

SEQ ID NO: 5 - DNA, 5862 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctgcagatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacattgtagcagagaacaactcgggttcggatgttctggagtggcttcaagcacagaaagtacaagtcagctcacaaccagagctcctcgatgtctcctggctgatcgaatgcataggagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgccctgcagaaaaggccggcggccacgaaaaaggccggccaggcaaaaaagaaaaagcaccaccaccaccaccactga

SEQ ID NO: 6 - protein, 1953 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLQMDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIGAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNALQKRPAATKKAGQAKKKKHHHHHH

SEQ ID NO: 7 - DNA, 6066 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctgcaggtgaaacaacagatacaacttcgtcgccgtgaagtcgatgaaacggcagacttgcccgctgaattgcctcccttgctgcgccgtttatacgccagccggggcgtgcgcagtgcgcaagaactggaacgcagtgttaaaggtatgttgccctggcagcaactgagcggcgtcgaaaaggccgttgagatcctttacaacgcttttcgcgaaggaacgcggattattgtggtcggcgattttgacgccgacggcgcgaccagcacggctctaagcgtgctggcgatgcgctcgcttggttgcagcaatatcgactatctggtaccaaaccgtttcgaagacggttacggcttaagcccggaagtagtcgatcaggcccatgcccgtggcgcgcagttaattgtcacggtggataacggtatttcctcccatgcgggcgttgaacacgctcgctcgttgggcattccggttattgttaccgatcaccatttgccgggcgaaacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtggcatcgcaattcctaacctggcagaactgctggatctggtcgcgctgggaacagtggcggacgtcgtgccgctggacgctaataatcgcattctgacctggcaggggatgagtcgcatccgtgccggaaagtgccgtccagggattaaagcgctgctggaagtggcaaaccgtgatgcacaaaaactcgccgccagcgatttaggttttgcgctggggccacgtctcaatgctgccggacgactggacgatatgtccgtcggtgtggcgctcttgctgtgcgacaacatcggcgaagcgcgcgtgctggcaaatgaactcgatgcgctaaaccagacgcgaaaagagatcgaacaaggaatgcaagttgaagccctgaccctgtgcgagaaactggagcgaagtcgcgacacgctacccggcgggctggcaatgtatcaccccgaatggcatcagggcgttgtcggtattctggcttcgcgcatcaaagagcgttttcaccgtccggttatcgcctttgcgccagcaggtgatggtacgctgaaaggttcaggtcgctccattcaggggctgcatatgcgtgatgcactggagcgattagacacactctaccctggcatgatactgaagtttggcggtcatgcgatggcggcgggtttgtcgctggaagaggataaattcgaactctttcaacaacggtttggcgagctggttaccgagtggctggacccttcgctattgcaaggcgaagtggtgtcagacggcccgttaagcccggccgaaatgaccatggaagtggcgcagctgctgcgcgatgctggcccgtgggggcagatgttcccggagccgctgtttgatggtcatttccgtctgctgcaacagcggctggtgggcgaacgtcatttgaaagtcatggtcgaaccggtcggcggcggtccgctgctggatggtattgcttttaatgtcgataccgccctctggccggataacggcgtgcgcgaagtgcaactggcttacaagctcgatatcaacgagtttcgcggcaaccgcagcctgcaaattatcatcgacaatatctggccaattctgcagaaaaggccggcggccacgaaaaaggccggccaggcaaaaaagaaaaagcaccaccaccaccaccactga

SEQ ID NO: 8 - protein, 2021 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLQVKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGETLPAAEAIINPNLRDCNFPSKSLAGVGVAFYLMLALRTFLRDQGWFDERGIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQVEALTLCEKLERSRDTLPGGLAMYHPEWHQGVVGILASRIKERFHRPVIAFAPAGDGTLKGSGRSIQGLHMRDALERLDTLYPGMILKFGGHAMAAGLSLEEDKFELFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPILQKRPAATKKAGQAKKKKHHHHHH

SEQ ID NO: 9 - DNA, 6933 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctgcagatgagcacaaaaccactcttcctgttacggaaagcgaaaaaatcatccggtgaacctgacgtcgtcctgtgggcaagcaacgattttgaatcgacctgtgccactctggactacctgatcgttaagtcaggtaaaaaactgagcagctattttaaagctgttgccacgaattttcctgtcgttaatgacctgcccgctgaaggtgagatcgattttacctggagtgaacgctatcaactcagcaaagactccatgacatgggaactaaaaccgggagcagcaccagacaacgctcactatcaaggcaataccaacgtcaacggcgaagacatgactgagattgaggagaatatgctactcccaatttctggccaggaactgcccattcgttggcttgctcaacacggcagcgaaaaaccggtaacgcacgtttcacgcgacggactccaggcattacacattgctcgggctgaagaactaccggctgttactgccctggctgtttcccacaaaaccagcctgctcgacccgctggaaattcgcgaactccacaaactggttcgtgacactgacaaagttttccctaatcctggtaattcaaacctgggactgataactgcttttttcgaagcatacctgaacgctgactacaccgatcgaggactgctgacaaaagagtggatgaagggtaatcgtgtttcacacatcactcgcacggcttccggtgctaatgctggcggcggaaacctcaccgatcgcggcgaaggtttcgtacacgatctgacgtcactggcgcgcgacgtagccactggcgtactggcccgttcaatggatctggacatctataaccttcatccggcacacgctaaacgcattgaggaaattatcgctgaaaataaaccgcccttttctgttttccgcgacaaattcatcaccatgcctggcgggctggattattcccgcgccatcgtggttgcgtccgtaaaagaagcaccaattgggatcgaggtcatccccgcgcacgtcactgaatatctgaacaaagtactgactgaaaccgatcatgccaaccctgatccggaaatcgtggatattgcctgcggtcgctcctctgccccgatgccgcagcgagtaacagaagaaggaaaacaggatgatgaagaaaaaccgcaaccatctggaacaacggcagttgaacagggagaggctgaaacaatggaaccggacgcaactgaacatcatcaggacacgcagccgctggatgctcagtcacaggtaaattctgttgatgcgaaatatcaggaactgcgggcagaactccatgaagcccggaaaaacattccatcaaaaaatcctgtcgatgacgataaattgcttgctgcatcacgtggtgaatttgttgacggaattagcgacccgaacgatccgaaatgggtaaaggggatccagactcgcgattgtgtgtaccagaaccagccagaaacggaaaaaaccagcccagatatgaatcaacctgagccagtagtgcaacaggaaccggaaatagcctgcaatgcctgcggccagactggcggggataactgccctgactgtggtgcggtgatgggcgacgcaacataccaggaaacattcgatgaagagagtcaggttgaagctaaggaaaatgatccggaggaaatggaaggcgctgaacatccgcacaatgagaatgctggcagcgatccgcatcgcgattgcagtgatgaaactggcgaagtcgcagatcccgtaatcgtagaagacatagagccaggtatttattacggaatttcgaatgagaattaccacgcgggtcccggtatcagtaagtctcagctcgatgacattgctgatactccggcactatatttgtggcgtaaaaatgcccccgtggacaccacaaagacaaaaacgctcgatttaggaactgctttccactgccgggtacttgaaccggaagaattcagtaaccgctttatcgtagcacctgaatttaaccgccgtacaaacgccggaaaagaagaagagaaagcgtttctgatggaatgcgcaagcacaggaaaaacggttatcactgcggaagaaggccggaaaattgaactcatgtatcaaagcgttatggctttgccgctggggcaatggcttgttgaaagcgccggacacgctgaatcatcaatttactgggaagatcctgaaacaggaattttgtgtcggtgccgtccggacaaaattatccctgaatttcactggatcatggacgtgaaaactacggcggatattcaacgattcaaaaccgcttattacgactaccgctatcacgttcaggatgcattctacagtgacggttatgaagcacagtttggagtgcagccaactttcgtttttctggttgccagcacaactattgaatgcggacgttatccggttgaaattttcatgatgggcgaagaagcaaaactggcaggtcaacaggaatatcaccgcaatctgcgaaccctgtctgactgcctgaataccgatgaatggccagctattaagacattatcactgccccgctgggctaaggaatatgcaaatgacctgcagaaaaggccggcggccacgaaaaaggccggccaggcaaaaaagaaaaagcaccaccaccaccaccactga

SEQ ID NO: 10 - protein, 2310 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLQMSTKPLFLLRKAKKSSGEPDVVLWASNDFESTCATLDYLIVKSGKKLSSYFKAVATNFPVVNDLPAEGEIDFTWSERYQLSKDSMTWELKPGAAPDNAHYQGNTNVNGEDMTEIEENMLLPISGQELPIRWLAQHGSEKPVTHVSRDGLQALHIARAEELPAVTALAVSHKTSLLDPLEIRELHKLVRDTDKVFPNPGNSNLGLITAFFEAYLNADYTDRGLLTKEWMKGNRVSHITRTASGANAGGGNLTDRGEGFVHDLTSLARDVATGVLARSMDLDIYNLHPAHAKRIEEIIAENKPPFSVFRDKFITMPGGLDYSRAIVVASVKEAPIGIEVIPAHVTEYLNKVLTETDHANPDPEIVDIACGRSSAPMPQRVTEEGKQDDEEKPQPSGTTAVEQGEAETMEPDATEHHQDTQPLDAQSQVNSVDAKYQELRAELHEARKNIPSKNPVDDDKLLAASRGEFVDGISDPNDPKWVKGIQTRDCVYQNQPETEKTSPDMNQPEPVVQQEPEIACNACGQTGGDNCPDCGAVMGDATYQETFDEESQVEAKENDPEEMEGAEHPHNENAGSDPHRDCSDETGEVADPVIVEDIEPGIYYGISNENYHAGPGISKSQLDDIADTPALYLWRKNAPVDTTKTKTLDLGTAFHCRVLEPEEFSNRFIVAPEFNRRTNAGKEEEKAFLMECASTGKTVITAEEGRKIELMYQSVMALPLGQWLVESAGHAESSIYWEDPETGILCRCRPDKIIPEFHWIMDVKTTADIQRFKTAYYDYRYHVQDAFYSDGYEAQFGVQPTFVFLVASTTIECGRYPVEIFMMGEEAKLAGQQEYHRNLRTLSDCLNTDEWPAIKTLSLPRWAKEYANDLQKRPAATKKAGQAKKKKHHHHHH

SEQ ID NO: 11 - DNA, 5013 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagatgacaccggacattatcctgcagcgtaccgggatcgatgtgagagctgtcgaacagggggatgatgcgtggcacaaattacggctcggcgtcatcaccgcttcagaagttcacaacgtgatagcaaaaccccgctccggaaagaagtggcctgacatgaaaatgtcctacttccacaccctgcttgctgaggtttgcaccggtgtggctccggaagttaacgctaaagcactggcctggggaaaacagtacgagaacgacgccagaaccctgtttgaattcacttccggcgtgaatgttactgaatccccgatcatctatcgcgacgaaagtatgcgtaccgcctgctctcccgatggtttatgcagtgacggcaacggccttgaactgaaatgcccgtttacctcccgggatttcatgaagttccggctcggtggtttcgaggccataaagtcagcttacatggcccaggtgcagtacagcatgtgggtgacgcgaaaaaatgcctggtactttgccaactatgacccgcgtatgaagcgtgaaggcctgcattatgtcgtgattgagcgggatgaaaagtacatggcgagttttgacgagatcgtgccggagttcatcgaaaaaatggacgaggcactggctgaaattggttttgtatttggggagcaatggcgactcgagaaaaggccggcggccacgaaaaaggccggccaggcaaaaaagaaaaagcaccaccaccaccaccactga

SEQ ID NO: 12 - protein, 1670 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEMTPDIILQRTGIDVRAVEQGDDAWHKLRLGVITASEVHNVIAKPRSGKKWPDMKMSYFHTLLAEVCTGVAPEVNAKALAWGKQYENDARTLFEFTSGVNVTESPIIYRDESMRTACSPDGLCSDGNGLELKCPFTSRDFMKFRLGGFEAIKSAYMAQVQYSMWVTRKNAWYFANYDPRMKREGLHYVVIERDEKYMASFDEIVPEFIEKMDEALAEIGFVFGEQWRLEKRPAATKKAGQAKKKKHHHHHH

SEQ ID NO: 13 - DNA, 5400 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctgcagatgcaaacgttacagatgagtctgttgacacaaccttacgttcagcctcgtttcccttgcaagcgttacccgaccttctccgcatcctgcagaactcaaaagacagcgatcacgaaaacagagaaggtgtttttcagtgagtcatttgatcaaacacgttgcacgcagcctctctcggaaaagaagaagagggtgttctttttggacgttaacccgctctgttacgaaggaagcaagcccagcttgcgctccttcgggcggtggctctctctgtttctccatcaagtcagcctcactgaccccgtcattgctgttattgatggagaaggaggcagcgagcatcgcagaaagttgctaccttcatataaagcacataggaaaaagttcatgagacacatgtcaagtggccatgttgggaggtctcatcaagttataaatgatgttcttggaaaatgcaacgtgccagttataaaggttgctggtcatgaagctgatgatgttgtagctactctagctggacaagttgtcaataaagggtttcgagtggtcattggctcccctgataaggattttaagcagcttatatctgaagatgtgcaaatagttatgcctttgccagagttacaaaggtggtccttctacactctgaggcactacagggatcagtataattgtgatccagaatctgatctgagctttagatgcattgtaggtgatgaagtagacggcgttcctggtatccagcatttggtccctagttttggtcggaagactgctatgaaacttattaaaaaacatggttccttggaaactttattaaatgcggctgcaataaggactgtaggcagaccatatgcacaggatgccctcaaaaaccatgctgattaccttcggagaaactatgaagttcttgccttgaaaagggatgtaaatatccaactttatgatgagtggttggttaagagagacaatcacaatgataaaactgcactatcttccttcttcaaatatttgggagaaagtaaggagctcagttacaatggcagacctatctcttacaatggtctgcagaaaaggccggcggccacgaaaaaggccggccaggcaaaaaagaaaaagcaccaccaccaccaccactga

SEQ ID NO: 14 - protein, 1799 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLQMQTLQMSLLTQPYVQPRFPCKRYPTFSASCRTQKTAITKTEKVFFSESFDQTRCTQPLSEKKKRVFFLDVNPLCYEGSKPSLRSFGRWLSLFLHQVSLTDPVIAVIDGEGGSEHRRKLLPSYKAHRKKFMRHMSSGHVGRSHQVINDVLGKCNVPVIKVAGHEADDVVATLAGQVVNKGFRVVIGSPDKDFKQLISEDVQIVMPLPELQRWSFYTLRHYRDQYNCDPESDLSFRCIVGDEVDGVPGIQHLVPSFGRKTAMKLIKKHGSLETLLNAAAIRTVGRPYAQDALKNHADYLRRNYEVLALKRDVNIQLYDEWLVKRDNHNDKTALSSFFKYLGESKELSYNGRPISYNGLQKRPAATKKAGQAKKKKHHHHHH

SEQ ID NO: 15 - DNA, 5163 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctgcagatggcttcccgtcgtaatctaatgattgtcgatggaactaacttaggctttcgcttcaaacataacaatagtaaaaaaccatttgcctcaagttatgtttcaactattcaatctctggcaaaatcctactctgccagaactacgattgttctaggtgataagggaaaatctgtatttcgtctagaacatctaccagagtataaaggtaatcgtgatgaaaagtacgcacaacgtacggaagaggagaaagcgctagatgagcagttctttgagtatttgaaggatgctttcgagttgtgtaaaactacattcccaacttttaccattcgtggtgtagaagcagacgatatggcagcttatattgttaagctcatcgggcatctttatgatcacgtttggctaatatctacagatggtgactgggatactttattaacggataaagtttctcgtttttctttcacaacacgtcgtgagtatcatcttcgtgatatgtatgaacatcataatgttgatgatgttgagcagtttatctccctgaaagcaattatgggagatctaggagataatattcgtggtgttgaaggaataggagcaaaacgcggatataatattattcgtgagtttggtaacgtactggatattattgatcagcttccactgcctggaaagcagaaatatatacagaacctgaatgcatcggaagaactgcttttccgaaacttgattctggttgatttacctacctactgtgtggatgctattgctgctgtaggtcaagatgtgttagataagtttacaaaagatattttggagattgcagaacaactgcagaaaaggccggcggccacgaaaaaggccggccaggcaaaaaagaaaaagcaccaccaccaccaccactga

SEQ ID NO: 16 - protein, 1720 aa, Artificial Sequence
  Description of Artificial Sequence: Synthetic polypeptide
MGSSHHHHHHSSGLVPRGSHMASMTGGQQMGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLQMASRRNLMIVDGTNLGFRFKHNNSKKPFASSYVSTIQSLAKSYSARTTIVLGDKGKSVFRLEHLPEYKGNRDEKYAQRTEEEKALDEQFFEYLKDAFELCKTTFPTFTIRGVEADDMAAYIVKLIGHLYDHVWLISTDGDWDTLLTDKVSRFSFTTRREYHLRDMYEHHNVDDVEQFISLKAIMGDLGDNIRGVEGIGAKRGYNIIREFGNVLDIIDQLPLPGKQKYIQNLNASEELLFRNLILVDLPTYCVDAIAAVGQDVLDKFTKDILEIAEQLQKRPAATKKAGQAKKKKHHHHHH

SEQ ID NO: 17 - DNA, 6066 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgtgaaacaacagatacaacttcgtcgccgtgaagtcgatgaaacggcagacttgcccgctgaattgcctcccttgctgcgccgtttatacgccagccggggcgtgcgcagtgcgcaagaactggaacgcagtgttaaaggtatgttgccctggcagcaactgagcggcgtcgaaaaggccgttgagatcctttacaacgcttttcgcgaaggaacgcggattattgtggtcggcgattttgacgccgacggcgcgaccagcacggctctaagcgtgctggcgatgcgctcgcttggttgcagcaatatcgactatctggtaccaaaccgtttcgaagacggttacggcttaagcccggaagtagtcgatcaggcccatgcccgtggcgcgcagttaattgtcacggtggataacggtatttcctcccatgcgggcgttgaacacgctcgctcgttgggcattccggttattgttaccgatcaccatttgccgggcgaaacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtggcatcgcaattcctaacctggcagaactgctggatctggtcgcgctgggaacagtggcggacgtcgtgccgctggacgctaataatcgcattctgacctggcaggggatgagtcgcatccgtgccggaaagtgccgtccagggattaaagcgctgctggaagtggcaaaccgtgatgcacaaaaactcgccgccagcgatttaggttttgcgctggggccacgtctcaatgctgccggacgactggacgatatgtccgtcggtgtggcgctcttgctgtgcgacaacatcggcgaagcgcgcgtgctggcaaatgaactcgatgcgctaaaccagacgcgaaaagagatcgaacaaggaatgcaagttgaagccctgaccctgtgcgagaaactggagcgaagtcgcgacacgctacccggcgggctggcaatgtatcaccccgaatggcatcagggcgttgtcggtattctggcttcgcgcatcaaagagcgttttcaccgtccggttatcgcctttgcgccagcaggtgatggtacgctgaaaggttcaggtcgctccattcaggggctgcatatgcgtgatgcactggagcgattagacacactctaccctggcatgatactgaagtttggcggtcatgcgatggcggcgggtttgtcgctggaagaggataaattcgaactctttcaacaacggtttggcgagctggttaccgagtggctggacccttcgctattgcaaggcgaagtggtgtcagacggcccgttaagcccggccgaaatgaccatggaagtggcgcagctgctgcgcgatgctggcccgtgggggcagatgttcccggagccgctgtttgatggtcatttccgtctgctgcaacagcggctggtgggcgaacgtcatttgaaagtcatggtcgaaccggtcggcggcggtccgctgctggatggtattgcttttaatgtcgataccgccctctggccggataacggcgtgcgcgaagtgcaactggcttacaagctcgatatcaacgagtttcgcggcaaccgcagcctgcaaattatcatcgacaatatctggccaattggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagaaaaggccggcggccacgaaaaaggccggccaggcaaaaaagaaaaagcaccaccaccaccaccactga

SEQ ID NO: 18 - protein, 2021 aa, Artificial Sequence
  Description of Artificial Sequence: Synthetic polypeptide
MGSSHHHHHHSSGLVPRGSHMASMTGGQQMGRGSVKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGETLPAAEAIINPNLRDCNFPSKSLAGVGVAFYLMLALRTFLRDQGWFDERGIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQVEALTLCEKLERSRDTLPGGLAMYHPEWHQGVVGILASRIKERFHRPVIAFAPAGDGTLKGSGRSIQGLHMRDALERLDTLYPGMILKFGGHAMAAGLSLEEDKFELFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPIGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEKRPAATKKAGQAKKKKHHHHHH

SEQ ID NO: 19 - DNA, 6933 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatgagcacaaaaccactcttcctgttacggaaagcgaaaaaatcatccggtgaacctgacgtcgtcctgtgggcaagcaacgattttgaatcgacctgtgccactctggactacctgatcgttaagtcaggtaaaaaactgagcagctattttaaagctgttgccacgaattttcctgtcgttaatgacctgcccgctgaaggtgagatcgattttacctggagtgaacgctatcaactcagcaaagactccatgacatgggaactaaaaccgggagcagcaccagacaacgctcactatcaaggcaataccaacgtcaacggcgaagacatgactgagattgaggagaatatgctactcccaatttctggccaggaactgcccattcgttggcttgctcaacacggcagcgaaaaaccggtaacgcacgtttcacgcgacggactccaggcattacacattgctcgggctgaagaactaccggctgttactgccctggctgtttcccacaaaaccagcctgctcgacccgctggaaattcgcgaactccacaaactggttcgtgacactgacaaagttttccctaatcctggtaattcaaacctgggactgataactgcttttttcgaagcatacctgaacgctgactacaccgatcgaggactgctgacaaaagagtggatgaagggtaatcgtgtttcacacatcactcgcacggcttccggtgctaatgctggcggcggaaacctcaccgatcgcggcgaaggtttcgtacacgatctgacgtcactggcgcgcgacgtagccactggcgtactggcccgttcaatggatctggacatctataaccttcatccggcacacgctaaacgcattgaggaaattatcgctgaaaataaaccgcccttttctgttttccgcgacaaattcatcaccatgcctggcgggctggattattcccgcgccatcgtggttgcgtccgtaaaagaagcaccaattgggatcgaggtcatccccgcgcacgtcactgaatatctgaacaaagtactgactgaaaccgatcatgccaaccctgatccggaaatcgtggatattgcctgcggtcgctcctctgccccgatgccgcagcgagtaacagaagaaggaaaacaggatgatgaagaaaaaccgcaaccatctggaacaacggcagttgaacagggagaggctgaaacaatggaaccggacgcaactgaacatcatcaggacacgcagccgctggatgctcagtcacaggtaaattctgttgatgcgaaatatcaggaactgcgggcagaactccatgaagcccggaaaaacattccatcaaaaaatcctgtcgatgacgataaattgcttgctgcatcacgtggtgaatttgttgacggaattagcgacccgaacgatccgaaatgggtaaaggggatccagactcgcgattgtgtgtaccagaaccagccagaaacggaaaaaaccagcccagatatgaatcaacctgagccagtagtgcaacaggaaccggaaatagcctgcaatgcctgcggccagactggcggggataactgccctgactgtggtgcggtgatgggcgacgcaacataccaggaaacattcgatgaagagagtcaggttgaagctaaggaaaatgatccggaggaaatggaaggcgctgaacatccgcacaatgagaatgctggcagcgatccgcatcgcgattgcagtgatgaaactggcgaagtcgcagatcccgtaatcgtagaagacatagagccaggtatttattacggaatttcgaatgagaattaccacgcgggtcccggtatcagtaagtctcagctcgatgacattgctgatactccggcactatatttgtggcgtaaaaatgcccccgtggacaccacaaagacaaaaacgctcgatttaggaactgctttccactgccgggtacttgaaccggaagaattcagtaaccgctttatcgtagcacctgaatttaaccgccgtacaaacgccggaaaagaagaagagaaagcgtttctgatggaatgcgcaagcacaggaaaaacggttatcactgcggaagaaggccggaaaattgaactcatgtatcaaagcgttatggctttgccgctggggcaatggcttgttgaaagcgccggacacgctgaatcatcaatttactgggaagatcctgaaacaggaattttgtgtcggtgccgtccggacaaaattatccctgaatttcactggatcatggacgtgaaaactacggcggatattcaacgattcaaaaccgcttattacgactaccgctatcacgttcaggatgcattctacagtgacggttatgaagcacagtttggagtgcagccaactttcgtttttctggttgccagcacaactattgaatgcggacgttatccggttgaaattttcatgatgggcgaagaagcaaaactggcaggtcaacaggaatatcaccgcaatctgcgaaccctgtctgactgcctgaataccgatgaatggccagctattaagacattatcactgccccgctgggctaaggaatatgcaaatgacggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagaaaaggccggcggccacgaaaaaggccggccaggcaaaaaagaaaaagcaccaccaccaccaccactga

SEQ ID NO: 20 - protein, 2310 aa, Artificial Sequence
  Description of Artificial Sequence: Synthetic polypeptide
MGSSHHHHHHSSGLVPRGSHMASMTGGQQMGRGSMSTKPLFLLRKAKKSSGEPDVVLWASNDFESTCATLDYLIVKSGKKLSSYFKAVATNFPVVNDLPAEGEIDFTWSERYQLSKDSMTWELKPGAAPDNAHYQGNTNVNGEDMTEIEENMLLPISGQELPIRWLAQHGSEKPVTHVSRDGLQALHIARAEELPAVTALAVSHKTSLLDPLEIRELHKLVRDTDKVFPNPGNSNLGLITAFFEAYLNADYTDRGLLTKEWMKGNRVSHITRTASGANAGGGNLTDRGEGFVHDLTSLARDVATGVLARSMDLDIYNLHPAHAKRIEEIIAENKPPFSVFRDKFITMPGGLDYSRAIVVASVKEAPIGIEVIPAHVTEYLNKVLTETDHANPDPEIVDIACGRSSAPMPQRVTEEGKQDDEEKPQPSGTTAVEQGEAETMEPDATEHHQDTQPLDAQSQVNSVDAKYQELRAELHEARKNIPSKNPVDDDKLLAASRGEFVDGISDPNDPKWVKGIQTRDCVYQNQPETEKTSPDMNQPEPVVQQEPEIACNACGQTGGDNCPDCGAVMGDATYQETFDEESQVEAKENDPEEMEGAEHPHNENAGSDPHRDCSDETGEVADPVIVEDIEPGIYYGISNENYHAGPGISKSQLDDIADTPALYLWRKNAPVDTTKTKTLDLGTAFHCRVLEPEEFSNRFIVAPEFNRRTNAGKEEEKAFLMECASTGKTVITAEEGRKIELMYQSVMALPLGQWLVESAGHAESSIYWEDPETGILCRCRPDKIIPEFHWIMDVKTTADIQRFKTAYYDYRYHVQDAFYSDGYEAQFGVQPTFVFLVASTTIECGRYPVEIFMMGEEAKLAGQQEYHRNLRTLSDCLNTDEWPAIKTLSLPRWAKEYANDGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEKRPAATKKAGQAKKKKHHHHHH

SEQ ID NO: 21 - DNA, 5049 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaaggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagaaaaggccggcggccacgaaaaaggccggccaggcaaaaaagaaaaagcaccaccaccaccaccactga

SEQ ID NO: 22 - protein, 1682 aa, Artificial Sequence
  Description of Artificial Sequence: Synthetic polypeptide
MGSSHHHHHHSSGLVPRGSHMASMTGGQQMGRGSMSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEKRPAATKKAGQAKKKKHHHHHH

SEQ ID NO: 23 - DNA, 4683 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggcgagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagaaaaggccggcggccacgaaaaaggccggccaggcaaaaaagaaaaagcaccaccaccaccaccactga

SEQ ID NO: 24 - protein, 1560 aa, Artificial Sequence
  Description of Artificial Sequence: Synthetic polypeptide
MGSSHHHHHHSSGLVPRGSHMASMTGGQQMGRGSMASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEKRPAATKKAGQAKKKKHHHHHH

SEQ ID NO: 25 - DNA, 6420 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggcgagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctgcaggtgaaacaacagatacaacttcgtcgccgtgaagtcgatgaaacggcagacttgcccgctgaattgcctcccttgctgcgccgtttatacgccagccggggagtacgcagtgcgcaagaactggaacgcagtgttaaaggtatgctgccctggcagcaactgagcggcgtcgaaaaggccgttgagatcctttacaacgcttttcgcgaaggaacgcggattattgtggtcggtgatttcgacgccgacggcgcgaccagcacggctctaagcgtgctggcgatgcgctcgcttggttgcagcaatatcgactacctggtaccaaaccgtttcgaagacggttacggcttaagcccggaagtggtcgatcaggcccatgcccgtggcgcgcagttaattgtcacggtggataacggtatttcctcccatgcgggggttgagcacgctcgctcgttgggcatcccggttattgttaccgatcaccatttgccaggcgacacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtaacatcgcaattcctaacctggcagaactgctggatctggtcgcgctggggacagtggcggacgtcgtgccgctggacgctaataatcgcattctgacctggcaggggatgagtcgcatccgagccggaaagtgccgtccggggattaaagcgctgcttgaagtggcaaaccgtgatgcacaaaaactcgccgccagcgatttaggttttgcgctggggccacgtctcaatgctgccggacgactggacgatatgtccgtcggtgtggcgctgttgttgtgcgacaacatcggcgaagcgcgcgtgctggcaaatgaactcgatgcgctaaaccagacgcgaaaagagatcgaacaaggaatgcaaattgaagccctgaccctgtgcgagaaactggagcgcagccgtgacacgctacccggcgggctggcaatgtatcaccccgaatggcatcagggcgttgtcggtattctggcttcgcgcatcaaagagcgttttcaccgtccggttatcgcgtttgcgccagcaggtgacggtacgctgaaaggttccggtcgctccattcaggggctgcatatgcgtgatgcgctggagcgattagacacactctaccctggcatgatgctgaagtttggcggtcatgcgatggcggcgggtttgtcgctggaagaggataaattcaaactctttcaacaacggtttggcgaactggttactgagtggctggacccttcgctattgcaaggcgaagtggtatcagacggtccgttaagcccggccgaaatgaccatggaagtggcgcagctgctgcgcgatgctggcccgtgggggcagatgttcccggagccgctgtttgacggtcatttccgtctgctgcaacagcggctggtgggcgaacgtcatttgaaggtgatggtcgaaccggtcggcggcggtccactgctggatggtattgcttttaatgtcgataccgccctctggccggataacggcgtgcgcgaagtgcaactggcttataagctcgatatcaacgagtttcgcggcaaccgcagcctgcaaattatcatcgacaatatctggccaattctgcagaaaaggccggcggccacgaaaaaggccggccaggcaaaaaagaaaaagcaccaccaccaccaccactga

SEQ ID NO: 26 - protein, 2139 aa, Artificial Sequence
  Description of Artificial Sequence: Synthetic polypeptide
MGSSHHHHHHSSGLVPRGSHMASMTGGQQMGRGSMASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLQVKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGDTLPAAEAIINPNLRDCNFPSKSLAGVGVAFYLMLALRTFLRDQGWFDERNIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQIEALTLCEKLERSRDTLPGGLAMYHPEWHQGVVGILASRIKERFHRPVIAFAPAGDGTLKGSGRSIQGLHMRDALERLDTLYPGMMLKFGGHAMAAGLSLEEDKFKLFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPILQKRPAATKKAGQAKKKKHHHHHH

SEQ ID NO: 27 - DNA, 4602 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatggctaaaaaagaaatggttgaatttgatgaagctatccatggcgaagacttggctaaatttattaaagaagcatctgatcataaactgaaaatttccggttataatgaactgattaaagatattcgaattcgtgctaaagatgaacttggcgttgatggtaagatgtttaatcgtctattagctttgtatcataaagataaccgtgatgtgtttgaagctgaaactgaagaggtagttgaactttatgacacagttttctctaaaggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctcgagaaaaggccggcggccacgaaaaaggccggccaggcaaaaaagaaaaagcaccaccaccaccaccactga

SEQ ID NO: 28 - protein, 1533 aa, Artificial Sequence
  Description of Artificial Sequence: Synthetic polypeptide
MGSSHHHHHHSSGLVPRGSHMASMTGGQQMGRGSMAKKEMVEFDEAIHGEDLAKFIKEASDHKLKISGYNELIKDIRIRAKDELGVDGKMFNRLLALYHKDNRDVFEAETEEVVELYDTVFSKGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLEKRPAATKKAGQAKKKKHHHHHH

SEQ ID NO: 29 - DNA, 6339 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatggctaaaaaagaaatggttgaatttgatgaagctatccatggcgaagacttggctaaatttattaaagaagcatctgatcataaactgaaaatttccggttataatgaactgattaaagatattcgaattcgtgctaaagatgaacttggcgttgatggtaagatgtttaatcgtctattagctttgtatcataaagataaccgtgatgtgtttgaagctgaaactgaagaggtagttgaactttatgacacagttttctctaaaggatccgaattcgagctccgtcgacaagcttgcggccgcatggacaagaagtacagcatcggcctggacatcggtaccaacagcgtgggctgggccgtgatcaccgacgagtacaaggtgcccagcaagaagttcaaggtgctgggcaacaccgaccgccacagcatcaagaagaacctgatcggcgccctgctgttcgacagcggcgagaccgccgaggccacccgcctgaagcgcaccgcccgccgccgctacacccgccgcaagaaccgcatctgctacctgcaggagatcttcagcaacgagatggccaaggtggacgacagcttcttccaccgcctggaggagagcttcctggtggaggaggacaagaagcacgagcgccaccccatcttcggcaacatcgtggacgaggtggcctaccacgagaagtaccccaccatctaccacctgcgcaagaagctggtggacagcaccgacaaggccgacctgcgcctgatctacctggccctggcccacatgatcaagttccgcggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccgcctgagcaagagccgccgcctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgcgtgaacaccgagatcaccaaggcccccctgagcgccagcatgatcaagcgctacgacgagcaccaccaggacctgaccctgctgaaggccctggtgcgccagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgcgaggacctgctgcgcaagcagcgcaccttcgacaacggcagcatcccccaccagatccacctgggcgagctgcacgccatcctgcgccgccaggaggacttctaccccttcctgaaggacaaccgcgagaagatcgagaagatcctgaccttccgcatcccctactacgtgggccccctggcccgcggcaacagccgcttcgcctggatgacccgcaagagcgaggagaccatcaccccctggaacttcgaggaggtggtggacaagggcgccagcgcccagagcttcatcgagcgcatgaccaacttcgacaagaacctgcccaacgagaaggtgctgcccaagcacagcctgctgtacgagtacttcaccgtgtacaacgagctgaccaaggtgaagtacgtgaccgagggcatgcgcaagcccgccttcctgagcggcgagcagaagaaggccatcgtggacctgctgttcaagaccaaccgcaaggtgaccgtgaagcagctgaaggaggactacttcaagaagatcgagtgcttcgacagcgtggagatcagcggcgtggaggaccgcttcaacgccagcctgggcacctaccacgacctgctgaagatcatcaaggacaaggacttcctggacaacgaggagaacgaggacatcctggaggacatcgtgctgaccctgaccctgttcgaggaccgcgagatgatcgaggagcgcctgaagacctacgcccacctgttcgacgacaaggtgatgaagcagctgaagcgccgccgctacaccggctggggccgcctgagccgcaagcttatcaacggcatccgcgacaagcagagcggcaagaccatcctggacttcctgaagagcgacggcttcgccaaccgcaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccgccacaagcccgagaacatcgtgatcgagatggcccgcgagaaccagaccacccagaagggccagaagaacagccgcgagcgcatgaagcgcatcgaggagggcatcaaggagctgggcagccagatcctgaaggagcaccccgtggagaacacccagctgcagaacgagaagctgtacctgtactacctgcagaacggccgcgacatgtacgtggaccaggagctggacatcaaccgcctgagcgactacgacgtggaccacatcgtgccccagagcttcctgaaggacgacagcatcgacaacaaggtgctgacccgcagcgacaagaaccgcggcaagagcgacaacgtgcccagcgaggaggtggtgaagaagatgaagaactactggcgccagctgctgaacgccaagctgatcacccagcgcaagttcgacaacctgaccaaggccgagcgcggcggcctgagcgagctggacaaggccggcttcatcaagcgccagctggtggagacccgccagatcaccaagcacgtggcccagatcctggacagccgcatgaacaccaagtacgacgagaacgacaagctgatccgcgaggtgaaggtgatcaccctgaagagcaagctggtgagcgacttccgcaaggacttccagttctacaaggtgcgcgagatcaacaactaccaccacgcccacgacgcctacctgaacgccgtggtgggcaccgccctgatcaagaagtaccccaagctggagagcgagttcgtgtacggcgactacaaggtgtacgacgtgcgcaagatgatcgccaagagcgagcaggagatcggcaaggccaccgccaagtacttcttctacagcaacatcatgaacttcttcaagaccgagatcaccctggccaacggcgagatccgcaagcgccccctgatcgagaccaacggcgagaccggcgagatcgtgtgggacaagggccgcgacttcgccaccgtgcgcaaggtgctgagcatgccccaggtgaacatcgtgaagaagaccgaggtgcagaccggcggcttcagcaaggagagcatcctgcccaagcgcaacagcgacaagctgatcgcccgcaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcgcagcagcttcgagaagaaccccatcgacttcctggaggccaagggctacaaggaggtgaagaaggacctgatcatcaagctgcccaagtacagcctgttcgagctggagaacggccgcaagcgcatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgcgtgatcctggccgacgccaacctggacaaggtgctgagcgcctacaacaagcaccgcgacaagcccatccgcgagcaggccgagaacatcatccacctgttcaccctgaccaacctgggcgcccccgccgccttcaagtacttcgacaccaccatcgaccgcaagcgctacaccagcaccaaggaggtgctggacgccaccctgatccaccagagcatcaccggtctgtacgagacccgcatcgacctgagccagctgggcggcgacgcggccgcactcgacctgcaggtgaaacaacagatacaacttcgtcgccgtgaagtcgatgaaacggcagacttgcccgctgaattgcctcccttgctgcgccgtttatacgccagccggggagtacgcagtgcgcaagaactggaacgcagtgttaaaggtatgctgccctggcagcaactgagcggcgtcgaaaaggccgttgagatcctttacaacgcttttcgcgaaggaacgcggattattgtggtcggtgatttcgacgccgacggcgcgaccagcacggctctaagcgtgctggcgatgcgctcgcttggttgcagcaatatcgactacctggtaccaaaccgtttcgaagacggttacggcttaagcccggaagtggtcgatcaggcccatgcccgtggcgcgcagttaattgtcacggtggataacggtatttcctcccatgcgggggttgagcacgctcgctcgttgggcatcccggttattgttaccgatcaccatttgccaggcgacacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtaacatcgcaattcctaacctggcagaactgctggatctggtcgcgctggggacagtggcggacgtcgtgccgctggacgctaataatcgcattctgacctggcaggggatgagtcgcatccgagccggaaagtgccgtccggggattaaagcgctgcttgaagtggcaaaccgtgatgcacaaaaactcgccgccagcgatttaggttttgcgctggggccacgtctcaatgctgccggacgactggacgatatgtccgtcggtgtggcgctgttgttgtgcgacaacatcggcgaagcgcgcgtgctggcaaatgaactcgatgcgctaaaccagacgcgaaaagagatcgaacaaggaatgcaaattgaagccctgaccctgtgcgagaaactggagcgcagccgtgacacgctacccggcgggctggcaatgtatcaccccgaatggcatcagggcgttgtcggtattctggcttcgcgcatcaaagagcgttttcaccgtccggttatcgcgtttgcgccagcaggtgacggtacgctgaaaggttccggtcgctccattcaggggctgcatatgcgtgatgcgctggagcgattagacacactctaccctggcatgatgctgaagtttggcggtcatgcgatggcggcgggtttgtcgctggaagaggataaattcaaactctttcaacaacggtttggcgaactggttactgagtggctggacccttcgctattgcaaggcgaagtggtatcagacggtccgttaagcccggccgaaatgaccatggaagtggcgcagctgctgcgcgatgctggcccgtgggggcagatgttcccggagccgctgtttgacggtcatttccgtctgctgcaacagcggctggtgggcgaacgtcatttgaaggtgatggtcgaaccggtcggcggcggtccactgctggatggtattgcttttaatgtcgataccgccctctggccggataacggcgtgcgcgaagtgcaactggcttataagctcgatatcaacgagtttcgcggcaaccgcagcctgcaaattatcatcgacaatatctggccaattctgcagaaaaggccggcggccacgaaaaaggccggccaggcaaaaaagaaaaagcaccaccaccaccaccactga

SEQ ID NO: 30 - protein, 2112 aa, Artificial Sequence
  Description of Artificial Sequence: Synthetic polypeptide
MGSSHHHHHHSSGLVPRGSHMASMTGGQQMGRGSMAKKEMVEFDEAIHGEDLAKFIKEASDHKLKISGYNELIKDIRIRAKDELGVDGKMFNRLLALYHKDNRDVFEAETEEVVELYDTVFSKGSEFELRRQACGRMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAAALDLQVKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGDTLPAAEAIINPNLRDCNFPSKSLAGVGVAFYLMLALRTFLRDQGWFDERNIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQIEALTLCEKLERSRDTLPGGLAMYHPEWHQGVVGILASRIKERFHRPVIAFAPAGDGTLKGSGRSIQGLHMRDALERLDTLYPGMMLKFGGHAMAAGLSLEEDKFKLFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPILQKRPAATKKAGQAKKKKHHHHHH

SEQ ID NO: 31 - DNA, 4140 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgagaaaaggccggcggccacgaaaaaggccggccaggcaaaaaagaaaaagtcgacaccaccaccaccaccactgagatccggctgctaa

SEQ ID NO: 32 - protein, 1379 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALEKRPAATKKAGQAKKKKSTPPPPPLRSGC

SEQ ID NO: 33 - DNA, 5865 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctgcaggtgaaacaacagatacaacttcgtcgccgtgaagtcgatgaaacggcagacttgcccgctgaattgcctcccttgctgcgccgtttatacgccagccggggcgtgcgcagtgcgcaagaactggaacgcagtgttaaaggtatgttgccctggcagcaactgagcggcgtcgaaaaggccgttgagatcctttacaacgcttttcgcgaaggaacgcggattattgtggtcggcgattttgacgccgacggcgcgaccagcacggctctaagcgtgctggcgatgcgctcgcttggttgcagcaatatcgactatctggtaccaaaccgtttcgaagacggttacggcttaagcccggaagtagtcgatcaggcccatgcccgtggcgcgcagttaattgtcacggtggataacggtatttcctcccatgcgggcgttgaacacgctcgctcgttgggcattccggttattgttaccgatcaccatttgccgggcgaaacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtggcatcgcaattcctaacctggcagaactgctggatctggtcgcgctgggaacagtggcggacgtcgtgccgctggacgctaataatcgcattctgacctggcaggggatgagtcgcatccgtgccggaaagtgccgtccagggattaaagcgctgctggaagtggcaaaccgtgatgcacaaaaactcgccgccagcgatttaggttttgcgctggggccacgtctcaatgctgccggacgactggacgatatgtccgtcggtgtggcgctcttgctgtgcgacaacatcggcgaagcgcgcgtgctggcaaatgaactcgatgcgctaaaccagacgcgaaaagagatcgaacaaggaatgcaagttgaagccctgaccctgtgcgagaaactggagcgaagtcgcgacacgctacccggcgggctggcaatgtatcaccccgaatggcatcagggcgttgtcggtattctggcttcgcgcatcaaagagcgttttcaccgtccggttatcgcctttgcgccagcaggtgatggtacgctgaaaggttcaggtcgctccattcaggggctgcatatgcgtgatgcactggagcgattagacacactctaccctggcatgatactgaagtttggcggtcatgcgatggcggcgggtttgtcgctggaagaggataaattcgaactctttcaacaacggtttggcgagctggttaccgagtggctggacccttcgctattgcaaggcgaagtggtgtcagacggcccgttaagcccggccgaaatgaccatggaagtggcgcagctgctgcgcgatgctggcccgtgggggcagatgttcccggagccgctgtttgatggtcatttccgtctgctgcaacagcggctggtgggcgaacgtcatttgaaagtcatggtcgaaccggtcggcggcggtccgctgctggatggtattgcttttaatgtcgataccgccctctggccggataacggcgtgcgcgaagtgcaactggcttacaagctcgatatcaacgagtttcgcggcaaccgcagcctgcaaattatcatcgacaatatctggccaattctgcagaaaaggccggcggccacgaaaaaggccggccaggcaaaaaagaaaaagcaccaccaccaccaccactga

SEQ ID NO: 34 - protein, 1954 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLQVKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGETLPAAEAIINPNLRDCNFPSKSLAGVGVAFYLMLALRTFLRDQGWFDERGIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQVEALTLCEKLERSRDTLPGGLAMYHPEWHQGVVGILASRIKERFHRPVIAFAPAGDGTLKGSGRSIQGLHMRDALERLDTLYPGMILKFGGHAMAAGLSLEEDKFELFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPILQKRPAATKKAGQAKKKKHHHHHH

SEQ ID NO: 35 - DNA, 6732 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctgcagatgagcacaaaaccactcttcctgttacggaaagcgaaaaaatcatccggtgaacctgacgtcgtcctgtgggcaagcaacgattttgaatcgacctgtgccactctggactacctgatcgttaagtcaggtaaaaaactgagcagctattttaaagctgttgccacgaattttcctgtcgttaatgacctgcccgctgaaggtgagatcgattttacctggagtgaacgctatcaactcagcaaagactccatgacatgggaactaaaaccgggagcagcaccagacaacgctcactatcaaggcaataccaacgtcaacggcgaagacatgactgagattgaggagaatatgctactcccaatttctggccaggaactgcccattcgttggcttgctcaacacggcagcgaaaaaccggtaacgcacgtttcacgcgacggactccaggcattacacattgctcgggctgaagaactaccggctgttactgccctggctgtttcccacaaaaccagcctgctcgacccgctggaaattcgcgaactccacaaactggttcgtgacactgacaaagttttccctaatcctggtaattcaaacctgggactgataactgcttttttcgaagcatacctgaacgctgactacaccgatcgaggactgctgacaaaagagtggatgaagggtaatcgtgtttcacacatcactcgcacggcttccggtgctaatgctggcggcggaaacctcaccgatcgcggcgaaggtttcgtacacgatctgacgtcactggcgcgcgacgtagccactggcgtactggcccgttcaatggatctggacatctataaccttcatccggcacacgctaaacgcattgaggaaattatcgctgaaaataaaccgcccttttctgttttccgcgacaaattcatcaccatgcctggcgggctggattattcccgcgccatcgtggttgcgtccgtaaaagaagcaccaattgggatcgaggtcatccccgcgcacgtcactgaatatctgaacaaagtactgactgaaaccgatcatgccaaccctgatccggaaatcgtggatattgcctgcggtcgctcctctgccccgatgccgcagcgagtaacagaagaaggaaaacaggatgatgaagaaaaaccgcaaccatctggaacaacggcagttgaacagggagaggctgaaacaatggaaccggacgcaactgaacatcatcaggacacgcagccgctggatgctcagtcacaggtaaattctgttgatgcgaaatatcaggaactgcgggcagaactccatgaagcccggaaaaacattccatcaaaaaatcctgtcgatgacgataaattgcttgctgcatcacgtggtgaatttgttgacggaattagcgacccgaacgatccgaaatgggtaaaggggatccagactcgcgattgtgtgtaccagaaccagccagaaacggaaaaaaccagcccagatatgaatcaacctgagccagtagtgcaacaggaaccggaaatagcctgcaatgcctgcggccagactggcggggataactgccctgactgtggtgcggtgatgggcgacgcaacataccaggaaacattcgatgaagagagtcaggttgaagctaaggaaaatgatccggaggaaatggaaggcgctgaacatccgcacaatgagaatgctggcagcgatccgcatcgcgattgcagtgatgaaactggcgaagtcgcagatcccgtaatcgtagaagacatagagccaggtatttattacggaatttcgaatgagaattaccacgcgggtcccggtatcagtaagtctcagctcgatgacattgctgatactccggcactatatttgtggcgtaaaaatgcccccgtggacaccacaaagacaaaaacgctcgatttaggaactgctttccactgccgggtacttgaaccggaagaattcagtaaccgctttatcgtagcacctgaatttaaccgccgtacaaacgccggaaaagaagaagagaaagcgtttctgatggaatgcgcaagcacaggaaaaacggttatcactgcggaagaaggccggaaaattgaactcatgtatcaaagcgttatggctttgccgctggggcaatggcttgttgaaagcgccggacacgctgaatcatcaatttactgggaagatcctgaaacaggaattttgtgtcggtgccgtccggacaaaattatccctgaatttcactggatcatggacgtgaaaactacggcggatattcaacgattcaaaaccgcttattacgactaccgctatcacgttcaggatgcattctacagtgacggttatgaagcacagtttggagtgcagccaactttcgtttttctggttgccagcacaactattgaatgcggacgttatccggttgaaattttcatgatgggcgaagaagcaaaactggcaggtcaacaggaatatcaccgcaatctgcgaaccctgtctgactgcctgaataccgatgaatggccagctattaagacattatcactgccccgctgggctaaggaatatgcaaatgacctgcagaaaaggccggcggccacgaaaaaggccggccaggcaaaaaagaaaaagcaccaccaccaccaccactga

SEQ ID NO: 36 - protein, 2243 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLQMSTKPLFLLRKAKKSSGEPDVVLWASNDFESTCATLDYLIVKSGKKLSSYFKAVATNFPVVNDLPAEGEIDFTWSERYQLSKDSMTWELKPGAAPDNAHYQGNTNVNGEDMTEIEENMLLPISGQELPIRWLAQHGSEKPVTHVSRDGLQALHIARAEELPAVTALAVSHKTSLLDPLEIRELHKLVRDTDKVFPNPGNSNLGLITAFFEAYLNADYTDRGLLTKEWMKGNRVSHITRTASGANAGGGNLTDRGEGFVHDLTSLARDVATGVLARSMDLDIYNLHPAHAKRIEEIIAENKPPFSVFRDKFITMPGGLDYSRAIVVASVKEAPIGIEVIPAHVTEYLNKVLTETDHANPDPEIVDIACGRSSAPMPQRVTEEGKQDDEEKPQPSGTTAVEQGEAETMEPDATEHHQDTQPLDAQSQVNSVDAKYQELRAELHEARKNIPSKNPVDDDKLLAASRGEFVDGISDPNDPKWVKGIQTRDCVYQNQPETEKTSPDMNQPEPVVQQEPEIACNACGQTGGDNCPDCGAVMGDATYQETFDEESQVEAKENDPEEMEGAEHPHNENAGSDPHRDCSDETGEVADPVIVEDIEPGIYYGISNENYHAGPGISKSQLDDIADTPALYLWRKNAPVDTTKTKTLDLGTAFHCRVLEPEEFSNRFIVAPEFNRRTNAGKEEEKAFLMECASTGKTVITAEEGRKIELMYQSVMALPLGQWLVESAGHAESSIYWEDPETGILCRCRPDKIIPEFHWIMDVKTTADIQRFKTAYYDYRYHVQDAFYSDGYEAQFGVQPTFVFLVASTTIECGRYPVEIFMMGEEAKLAGQQEYHRNLRTLSDCLNTDEWPAIKTLSLPRWAKEYANDLQKRPAATKKAGQAKKKKHHHHHH

SEQ ID NO: 37 - DNA, 5658 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctcgagatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacattgtagcagagaacaactcgggttcggatgttctggagtggcttcaagcacagaaagtacaagtcagctcacaaccagagctcctcgatgtctcctggctgatcgaatgcataggagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgccctcgagaaaaggccggcggccacgaaaaaggccggccaggcaaaaaagaaaaagcaccaccaccaccactga

SEQ ID NO: 38 - protein, 1885 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLEMDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIGAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNALEKRPAATKKAGQAKKKKHHHHH

SEQ ID NO: 39 - DNA, 4959 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctgcagatggcttcccgtcgtaatctaatgattgtcgatggaactaacttaggctttcgcttcaaacataacaatagtaaaaaaccatttgcctcaagttatgtttcaactattcaatctctggcaaaatcctactctgccagaactacgattgttctaggtgataagggaaaatctgtatttcgtctagaacatctaccagagtataaaggtaatcgtgatgaaaagtacgcacaacgtacggaagaggagaaagcgctagatgagcagttctttgagtatttgaaggatgctttcgagttgtgtaaaactacattcccaacttttaccattcgtggtgtagaagcagacgatatggcagcttatattgttaagctcatcgggcatctttatgatcacgtttggctaatatctacagatggtgactgggatactttattaacggataaagtttctcgtttttctttcacaacacgtcgtgagtatcatcttcgtgatatgtatgaacatcataatgttgatgatgttgagcagtttatctccctgaaagcaattatgggagatctaggagataatattcgtggtgttgaaggaataggagcaaaacgcggatataatattattcgtgagtttggtaacgtactggatattattgatcagcttccactgcctggaaagcagaaatatatacagaacctgaatgcatcggaagaactgcttttccgaaacttgattctggttgatttacctacctactgtgtggatgctattgctgctgtaggtcaagatgtgttagataagtttacaaaagatattttggagattgcagaacaactgcagaaaaggccggcggccacgaaaaaggccggccaggcaaaaaagaaaaagcaccaccaccaccactga

SEQ ID NO: 40 - protein, 1652 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLQMASRRNLMIVDGTNLGFRFKHNNSKKPFASSYVSTIQSLAKSYSARTTIVLGDKGKSVFRLEHLPEYKGNRDEKYAQRTEEEKALDEQFFEYLKDAFELCKTTFPTFTIRGVEADDMAAYIVKLIGHLYDHVWLISTDGDWDTLLTDKVSRFSFTTRREYHLRDMYEHHNVDDVEQFISLKAIMGDLGDNIRGVEGIGAKRGYNIIREFGNVLDIIDQLPLPGKQKYIQNLNASEELLFRNLILVDLPTYCVDAIAAVGQDVLDKFTKDILEIAEQLQKRPAATKKAGQAKKKKHHHHH

SEQ ID NO: 41 - DNA, 4809 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctcgagatgacaccggacattatcctgcagcgtaccgggatcgatgtgagagctgtcgaacagggggatgatgcgtggcacaaattacggctcggcgtcatcaccgcttcagaagttcacaacgtgatagcaaaaccccgctccggaaagaagtggcctgacatgaaaatgtcctacttccacaccctgcttgctgaggtttgcaccggtgtggctccggaagttaacgctaaagcactggcctggggaaaacagtacgagaacgacgccagaaccctgtttgaattcacttccggcgtgaatgttactgaatccccgatcatctatcgcgacgaaagtatgcgtaccgcctgctctcccgatggtttatgcagtgacggcaacggccttgaactgaaatgcccgtttacctcccgggatttcatgaagttccggctcggtggtttcgaggccataaagtcagcttacatggcccaggtgcagtacagcatgtgggtgacgcgaaaaaatgcctggtactttgccaactatgacccgcgtatgaagcgtgaaggcctgcattatgtcgtgattgagcgggatgaaaagtacatggcgagttttgacgagatcgtgccggagttcatcgaaaaaatggacgaggcactggctgaaattggttttgtatttggggagcaatggcgactcgagaaaaggccggcggccacgaaaaaggccggccaggcaaaaaagaaaaagcaccaccaccaccactga

SEQ ID NO: 42 - protein, 1602 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLEMTPDIILQRTGIDVRAVEQGDDAWHKLRLGVITASEVHNVIAKPRSGKKWPDMKMSYFHTLLAEVCTGVAPEVNAKALAWGKQYENDARTLFEFTSGVNVTESPIIYRDESMRTACSPDGLCSDGNGLELKCPFTSRDFMKFRLGGFEAIKSAYMAQVQYSMWVTRKNAWYFANYDPRMKREGLHYVVIERDEKYMASFDEIVPEFIEKMDEALAEIGFVFGEQWRLEKRPAATKKAGQAKKKKHHHHH

SEQ ID NO: 43 - DNA, 5196 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctgcagatgcaaacgttacagatgagtctgttgacacaaccttacgttcagcctcgtttcccttgcaagcgttacccgaccttctccgcatcctgcagaactcaaaagacagcgatcacgaaaacagagaaggtgtttttcagtgagtcatttgatcaaacacgttgcacgcagcctctctcggaaaagaagaagagggtgttctttttggacgttaacccgctctgttacgaaggaagcaagcccagcttgcgctccttcgggcggtggctctctctgtttctccatcaagtcagcctcactgaccccgtcattgctgttattgatggagaaggaggcagcgagcatcgcagaaagttgctaccttcatataaagcacataggaaaaagttcatgagacacatgtcaagtggccatgttgggaggtctcatcaagttataaatgatgttcttggaaaatgcaacgtgccagttataaaggttgctggtcatgaagctgatgatgttgtagctactctagctggacaagttgtcaataaagggtttcgagtggtcattggctcccctgataaggattttaagcagcttatatctgaagatgtgcaaatagttatgcctttgccagagttacaaaggtggtccttctacactctgaggcactacagggatcagtataattgtgatccagaatctgatctgagctttagatgcattgtaggtgatgaagtagacggcgttcctggtatccagcatttggtccctagttttggtcggaagactgctatgaaacttattaaaaaacatggttccttggaaactttattaaatgcggctgcaataaggactgtaggcagaccatatgcacaggatgccctcaaaaaccatgctgattaccttcggagaaactatgaagttcttgccttgaaaagggatgtaaatatccaactttatgatgagtggttggttaagagagacaatcacaatgataaaactgcactatcttccttcttcaaatatttgggagaaagtaaggagctcagttacaatggcagacctatctcttacaatggtctgcagaaaaggccggcggccacgaaaaaggccggccaggcaaaaaagaaaaagcaccaccaccaccactga

SEQ ID NO: 44 - protein, 1731 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLQMQTLQMSLLTQPYVQPRFPCKRYPTFSASCRTQKTAITKTEKVFFSESFDQTRCTQPLSEKKKRVFFLDVNPLCYEGSKPSLRSFGRWLSLFLHQVSLTDPVIAVIDGEGGSEHRRKLLPSYKAHRKKFMRHMSSGHVGRSHQVINDVLGKCNVPVIKVAGHEADDVVATLAGQVVNKGFRVVIGSPDKDFKQLISEDVQIVMPLPELQRWSFYTLRHYRDQYNCDPESDLSFRCIVGDEVDGVPGIQHLVPSFGRKTAMKLIKKHGSLETLLNAAAIRTVGRPYAQDALKNHADYLRRNYEVLALKRDVNIQLYDEWLVKRDNHNDKTALSSFFKYLGESKELSYNGRPISYNGLQKRPAATKKAGQAKKKKHHHHH

SEQ ID NO: 45 - DNA, 4845 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctcgagatgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaactcgagaaaaggccggcggccacgaaaaaggccggccaggcaaaaaagaaaaagcaccaccaccaccactga

SEQ ID NO: 46 - protein, 1614 aa, Artificial Sequence
  Description of Artificial Sequence: Synthetic polypeptide
MGSSHHHHHHSSGLVPRGSHMASMTGGQQMGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLEMSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKLEKRPAATKKAGQAKKKKHHHHH

SEQ ID NO: 47 - DNA, 5877 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccgtgaaacaacagatacaacttcgtcgccgtgaagtcgatgaaacggcagacttgcccgctgaattgcctcccttgctgcgccgtttatacgccagccggggcgtgcgcagtgcgcaagaactggaacgcagtgttaaaggtatgttgccctggcagcaactgagcggcgtcgaaaaggccgttgagatcctttacaacgcttttcgcgaaggaacgcggattattgtggtcggcgattttgacgccgacggcgcgaccagcacggctctaagcgtgctggcgatgcgctcgcttggttgcagcaatatcgactatctggtaccaaaccgtttcgaagacggttacggcttaagcccggaagtagtcgatcaggcccatgcccgtggcgcgcagttaattgtcacggtggataacggtatttcctcccatgcgggcgttgaacacgctcgctcgttgggcattccggttattgttaccgatcaccatttgccgggcgaaacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtggcatcgcaattcctaacctggcagaactgctggatctggtcgcgctgggaacagtggcggacgtcgtgccgctggacgctaataatcgcattctgacctggcaggggatgagtcgcatccgtgccggaaagtgccgtccagggattaaagcgctgctggaagtggcaaaccgtgatgcacaaaaactcgccgccagcgatttaggttttgcgctggggccacgtctcaatgctgccggacgactggacgatatgtccgtcggtgtggcgctcttgctgtgcgacaacatcggcgaagcgcgcgtgctggcaaatgaactcgatgcgctaaaccagacgcgaaaagagatcgaacaaggaatgcaagttgaagccctgaccctgtgcgagaaactggagcgaagtcgcgacacgctacccggcgggctggcaatgtatcaccccgaatggcatcagggcgttgtcggtattctggcttcgcgcatcaaagagcgttttcaccgtccggttatcgcctttgcgccagcaggtgatggtacgctgaaaggttcaggtcgctccattcaggggctgcatatgcgtgatgcactggagcgattagacacactctaccctggcatgatactgaagtttggcggtcatgcgatggcggcgggtttgtcgctggaagaggataaattcgaactctttcaacaacggtttggcgagctggttaccgagtggctggacccttcgctattgcaaggcgaagtggtgtcagacggcccgttaagcccggccgaaatgaccatggaagtggcgcagctgctgcgcgatgctggcccgtgggggcagatgttcccggagccgctgtttgatggtcatttccgtctgctgcaacagcggctggtgggcgaacgtcatttgaaagtcatggtcgaaccggtcggcggcggtccgctgctggatggtattgcttttaatgtcgataccgccctctggccggataacggcgtgcgcgaagtgcaactggcttacaagctcgatatcaacgagtttcgcggcaaccgcagcctgcaaattatcatcgacaatatctggccaattggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgagaaaaggccggcggccacgaaaaaggccggccaggcaaaaaagaaaaagtcgacaccaccaccaccaccactgagatccggctgctaa

SEQ ID NO: 48 - protein, 1958 aa, Artificial Sequence
  Description of Artificial Sequence: Synthetic polypeptide
MGSSHHHHHHSSGLVPRGSHMASMTGGQQMGRGSVKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGETLPAAEAIINPNLRDCNFPSKSLAGVGVAFYLMLALRTFLRDQGWFDERGIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQVEALTLCEKLERSRDTLPGGLAMYHPEWHQGVVGILASRIKERFHRPVIAFAPAGDGTLKGSGRSIQGLHMRDALERLDTLYPGMILKFGGHAMAAGLSLEEDKFELFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPIGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALEKRPAATKKAGQAKKKKSTPPPPPLRSGC

SEQ ID NO: 49 - DNA, 4860 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaaggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgagaaaaggccggcggccacgaaaaaggccggccaggcaaaaaagaaaaagtcgacaccaccaccaccaccactgagatccggctgctaa

SEQ ID NO: 50 - protein, 1619 aa, Artificial Sequence
  Description of Artificial Sequence: Synthetic polypeptide
MGSSHHHHHHSSGLVPRGSHMASMTGGQQMGRGSMSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALEKRPAATKKAGQAKKKKSTPPPPPLRSGC

SEQ ID NO: 51 - DNA, 4494 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggcgagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgagaaaaggccggcggccacgaaaaaggccggccaggcaaaaaagaaaaagtcgacaccaccaccaccaccactgagatccggctgctaa

SEQ ID NO: 52 - protein, 1497 aa, Artificial Sequence
  Description of Artificial Sequence: Synthetic polypeptide
MGSSHHHHHHSSGLVPRGSHMASMTGGQQMGRGSMASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALEKRPAATKKAGQAKKKKSTPPPPPLRSGC

SEQ ID NO: 53 - DNA, 6219 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggcgagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgacctgcaggtgaaacaacagatacaacttcgtcgccgtgaagtcgatgaaacggcagacttgcccgctgaattgcctcccttgctgcgccgtttatacgccagccggggagtacgcagtgcgcaagaactggaacgcagtgttaaaggtatgctgccctggcagcaactgagcggcgtcgaaaaggccgttgagatcctttacaacgcttttcgcgaaggaacgcggattattgtggtcggtgatttcgacgccgacggcgcgaccagcacggctctaagcgtgctggcgatgcgctcgcttggttgcagcaatatcgactacctggtaccaaaccgtttcgaagacggttacggcttaagcccggaagtggtcgatcaggcccatgcccgtggcgcgcagttaattgtcacggtggataacggtatttcctcccatgcgggggttgagcacgctcgctcgttgggcatcccggttattgttaccgatcaccatttgccaggcgacacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtaacatcgcaattcctaacctggcagaactgctggatctggtcgcgctggggacagtggcggacgtcgtgccgctggacgctaataatcgcattctgacctggcaggggatgagtcgcatccgagccggaaagtgccgtccggggattaaagcgctgcttgaagtggcaaaccgtgatgcacaaaaactcgccgccagcgatttaggttttgcgctggggccacgtctcaatgctgccggacgactggacgatatgtccgtcggtgtggcgctgttgttgtgcgacaacatcggcgaagcgcgcgtgctggcaaatgaactcgatgcgctaaaccagacgcgaaaagagatcgaacaaggaatgcaaattgaagccctgaccctgtgcgagaaactggagcgcagccgtgacacgctacccggcgggctggcaatgtatcaccccgaatggcatcagggcgttgtcggtattctggcttcgcgcatcaaagagcgttttcaccgtccggttatcgcgtttgcgccagcaggtgacggtacgctgaaaggttccggtcgctccattcaggggctgcatatgcgtgatgcgctggagcgattagacacactctaccctggcatgatgctgaagtttggcggtcatgcgatggcggcgggtttgtcgctggaagaggataaattcaaactctttcaacaacggtttggcgaactggttactgagtggctggacccttcgctattgcaaggcgaagtggtatcagacggtccgttaagcccggccgaaatgaccatggaagtggcgcagctgctgcgcgatgctggcccgtgggggcagatgttcccggagccgctgtttgacggtcatttccgtctgctgcaacagcggctggtgggcgaacgtcatttgaaggtgatggtcgaaccggtcggcggcggtccactgctggatggtattgcttttaatgtcgataccgccctctggccggataacggcgtgcgcgaagtgcaactggcttataagctcgatatcaacgagtttcgcggcaaccgcagcctgcaaattatcatcgacaatatctggccaattctgcagaaaaggccggcggccacgaaaaaggccggccaggcaaaaaagaaaaagcaccaccaccaccaccactga

SEQ ID NO: 54 - protein, 2072 aa, Artificial Sequence
  Description of Artificial Sequence: Synthetic polypeptide
MGSSHHHHHHSSGLVPRGSHMASMTGGQQMGRGSMASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALDLQVKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGDTLPAAEAIINPNLRDCNFPSKSLAGVGVAFYLMLALRTFLRDQGWFDERNIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQIEALTLCEKLERSRDTLPGGLAMYHPEWHQGVVGILASRIKERFHRPVIAFAPAGDGTLKGSGRSIQGLHMRDALERLDTLYPGMMLKFGGHAMAAGLSLEEDKFKLFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPILQKRPAATKKAGQAKKKKHHHHHH

SEQ ID NO: 55 - DNA, 4413 bp, Artificial Sequence
  Description of Artificial Sequence: Synthetic polynucleotide
atgggcagcagccatcatcatcatcatcacagcagcggcctggtgccgcgcggcagccatatggctagcatgactggtggacagcaaatgggtcgcggatccatggctaaaaaagaaatggttgaatttgatgaagctatccatggcgaagacttggctaaatttattaaagaagcatctgatcataaactgaaaatttccggttataatgaactgattaaagatattcgaattcgtgctaaagatgaacttggcgttgatggtaagatgtttaatcgtctattagctttgtatcataaagataaccgtgatgtgtttgaagctgaaactgaagaggtagttgaactttatgacacagttttctctaaaggatccgaattcgagctccgtcgacaagcttgcggccgcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataaccaagcggccgcactcgagaaaaggccggcggccacgaaaaaggccggccaggcaaaaaagaaaaagtcgacaccaccaccaccaccactgagatccggctgctaa

SEQ ID NO: 56 - protein, 1470 aa, Artificial Sequence
  Description of Artificial Sequence: Synthetic polypeptide
MGSSHHHHHHSSGLVPRGSHMASMTGGQQMGRGSMAKKEMVEFDEAIHGEDLAKFIKEASDHKLKISGYNELIKDIRIRAKDELGVDGKMFNRLLALYHKDNRDVFEAETEEVVELYDTVFSKGSEFELRRQACGRMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNQAAALEKRPAATKKAGQAKKKKSTPPPPPLRSGC

SEQ ID NO: 57 - DNA, 19 bp, Artificial Sequence
  Description of Artificial Sequence: Synthetic oligonucleotide
tcaaccaccctgtgaattt

SEQ ID NO: 58 - DNA, 21 bp, Artificial Sequence
  Description of Artificial Sequence: Synthetic primer
ggattggattggtattgtcgt

SEQ ID NO: 59 - DNA, 18 bp, Artificial Sequence
  Description of Artificial Sequence: Synthetic primer
tcacttttgatgaactat

SEQ ID NO: 60 - DNA, 23 bp, Artificial Sequence
  Description of Artificial Sequence: Synthetic oligonucleotide
caagggcttctaaagcttgcaaa

SEQ ID NO: 61 - DNA, 27 bp, Artificial Sequence
  Description of Artificial Sequence: Synthetic primer
gcagaattagttgagcgccaccagata

SEQ ID NO: 62 - DNA, 40 bp, Artificial Sequence
  Description of Artificial Sequence: Synthetic primer
gtgcaaaacaacagcaaaagaagataacaataacaataac

SEQ ID NO: 63 - DNA, 56 bp, Artificial Sequence
  Description of Artificial Sequence: Synthetic oligonucleotide
cctcgcagggaggtggactggttttgaattccactggcgagcgtcatcttcctact

SEQ ID NO: 64 - protein, 16 aa, Artificial Sequence
  Description of Artificial Sequence: Synthetic peptide
SGSETPGTSESATPES

SEQ ID NO: 65 - protein, 18 aa, Artificial Sequence
  Description of Artificial Sequence: Synthetic peptide
GGSGGSGGSGGSGGSGGS

SEQ ID NO: 66 - protein, 5 aa, Artificial Sequence
  Description of Artificial Sequence: Synthetic peptide
GGGGS

SEQ ID NO: 67 - protein, 41 aa, Artificial Sequence
  Description of Artificial Sequence: Synthetic polypeptide
VTEWLDPSLLQGEVVSDGPLSPAEMTMEVAQLLRDAGPWGQ

SEQ ID NO: 68 - protein, 9 aa, Artificial Sequence
  Description of Artificial Sequence: Synthetic peptide
GGSGGSGGS

SEQ ID NO: 69 - protein, 18 aa, Artificial Sequence
  Description of Artificial Sequence: Synthetic peptide
GGSGGSGGSGGSGGSGGS

SEQ ID NO: 70 - protein, 10 aa, Artificial Sequence
  Description of Artificial Sequence: Synthetic peptide
MKIIEQLPSA

SEQ ID NO: 71 - protein, 10 aa, Artificial Sequence
  Description of Artificial Sequence: Synthetic peptide
VRHKLKRVGS

SEQ ID NO: 72 - protein, 15 aa, Artificial Sequence
  Description of Artificial Sequence: Synthetic peptide
VPFLLEPDNINGKTC

SEQ ID NO: 73 - protein, 12 aa, Artificial Sequence
  Description of Artificial Sequence: Synthetic peptide
GHGTGSTGSGSS

SEQ ID NO: 74 - protein, 7 aa, Artificial Sequence
  Description of Artificial Sequence: Synthetic peptide
MSRPDPA

SEQ ID NO: 75 - protein, 12 aa, Artificial Sequence
  Description of Artificial Sequence: Synthetic peptide
GSAGSAAGSGEF

SEQ ID NO: 76 - protein, 12 aa, Artificial Sequence
  Description of Artificial Sequence: Synthetic peptide
SGSETPGTSESA

SEQ ID NO: 77 - protein, 21 aa, Artificial Sequence
  Description of Artificial Sequence: Synthetic peptide
SGSETPGTSESATPEGGSGGS

SEQ ID NO: 78 - protein, 6 aa, Artificial Sequence
  Description of Artificial Sequence: Synthetic 6xHis tag
HHHHHH

SEQ ID NO: 79 - DNA, 106 bp, Artificial Sequence
  Description of Artificial Sequence: Synthetic polynucleotide
tggaacaagatggattatcaagtgtcaagtccaatctatgacatcaattattatacatatgcatcggagccctgccaaaaaatcaatgtgaagcaaatcgcagccc

SEQ ID NO: 80 - DNA, 106 bp, Artificial Sequence
  Description of Artificial Sequence: Synthetic polynucleotide
atgggccccagtgtgactgcctgcatccgtcctcgcagggaggtggactggttttgaattccactggcgagcgtcatcttcctactgctgttcgcccccttcatcg

SEQ ID NO: 81 - DNA, 106 bp, Artificial Sequence
  Description of Artificial Sequence: Synthetic polynucleotide
aattctctgaggctttcttttaaatatacataaggaactttcggagtgaagggagagtttcatatggtcaataacttgatgcatgtgaaggggagataaaaaggtt

SEQ ID NO: 82 - DNA, 106 bp, Artificial Sequence
  Description of Artificial Sequence: Synthetic polynucleotide
tggccctggggccgtttccctcactcctgctcggtgaatttggctcagcaggcacctgccgaattctcagctgctcacttgagcctctgggtctagaaccctctgg

SEQ ID NO: 83 - DNA, 55 bp, Artificial Sequence
  Description of Artificial Sequence: Synthetic primer
tcgtcggcagcgtcagatgtgtataagagacagggagggcaactaaatacattct

SEQ ID NO: 84 - DNA, 55 bp, Artificial Sequence
  Description of Artificial Sequence: Synthetic primer
gtctcgtgggctcggagatgtgtataagagacaggaacaccagtgagtagagcgg

SEQ ID NO: 85 - DNA, 53 bp, Artificial Sequence
  Description of Artificial Sequence: Synthetic primer
tcgtcggcagcgtcagatgtgtataagagacagggtttgagcaacagttctcc

SEQ ID NO: 86 - DNA, 52 bp, Artificial Sequence
  Description of Artificial Sequence: Synthetic primer
gtctcgtgggctcggagatgtgtataagagacagtgacgatgtccaccacag

SEQ ID NO: 87 - DNA, 53 bp, Artificial Sequence
  Description of Artificial Sequence: Synthetic primer
tcgtcggcagcgtcagatgtgtataagagacagggtatttctgttcagatcac

SEQ ID NO: 88 - DNA, 55 bp, Artificial Sequence
  Description of Artificial Sequence: Synthetic primer
gtctcgtgggctcggagatgtgtataagagacaggcccatcaattatagaaagcc

SEQ ID NO: 89 - DNA, 53 bp, Artificial Sequence
  Description of Artificial Sequence: Synthetic primer
tcgtcggcagcgtcagatgtgtataagagacagctgcacacagcaggcctttg

SEQ ID NO: 90 - DNA, 54 bp, Artificial Sequence
  Description of Artificial Sequence: Synthetic primer
gtctcgtgggctcggagatgtgtataagagacagcccaataagtggcagagtgc

SEQ ID NO: 91 - DNA, 20 bp, Artificial Sequence
  Description of Artificial Sequence: Synthetic oligonucleotide
tgacatcaattattatacat

SEQ ID NO: 92 - DNA, 20 bp, Artificial Sequence
  Description of Artificial Sequence: Synthetic oligonucleotide
ggaggtggactggttttcac

SEQ ID NO: 93 - DNA, 20 bp, Artificial Sequence
  Description of Artificial Sequence: Synthetic oligonucleotide
tgacatcaattattatagat

SEQ ID NO: 94 - DNA, 20 bp, Artificial Sequence
  Description of Artificial Sequence: Synthetic oligonucleotide
tgacatcacttattatgcat

SEQ ID NO: 95 - DNA, 20 bp, Artificial Sequence
  Description of Artificial Sequence: Synthetic oligonucleotide
tgacataaattattctacat

SEQ ID NO: 96 - DNA, 20 bp, Artificial Sequence
  Description of Artificial Sequence: Synthetic oligonucleotide
tgaaatcaattatcatagat

SEQ ID NO: 97 - DNA, 55 bp, Artificial Sequence
  Description of Artificial Sequence: Synthetic primer
tcgtcggcagcgtcagatgtgtataagagacaggcatttggtgtaggtttaggct

SEQ ID NO: 98 - DNA, 56 bp, Artificial Sequence
  Description of Artificial Sequence: Synthetic primer
gtctcgtgggctcggagatgtgtataagagacagaattctgaaaatccaagtctat

SEQ ID NO: 99 - DNA, 55 bp, Artificial Sequence
  Description of Artificial Sequence: Synthetic primer
tcgtcggcagcgtcagatgtgtataagagacagacttctcttgggctgagtatga

SEQ ID NO: 100 - DNA, 56 bp, Artificial Sequence
  Description of Artificial Sequence: Synthetic primer
gtctcgtgggctcggagatgtgtataagagacagcagtaagtttggatatttgaaa

SEQ ID NO: 101 - DNA, 22 bp, Artificial Sequence
  Description of Artificial Sequence: Synthetic primer
cagtagagcaggcatgttgagt

SEQ ID NO: 102 - DNA, 22 bp, Artificial Sequence
  Description of Artificial Sequence: Synthetic primer
gtgaaggtgtatcaaacgctga

SEQ ID NO: 103 - DNA, 19 bp, Artificial Sequence
  Description of Artificial Sequence: Synthetic primer
gggaaaccactggccttgg

SEQ ID NO: 104 - DNA, 20 bp, Artificial Sequence
  Description of Artificial Sequence: Synthetic primer
gagccaggatccatgtccca

SEQ ID NO: 105 - DNA, 30 bp, Artificial Sequence
  Description of Artificial Sequence: Synthetic oligonucleotide
cagggaggtggactggttttccatggcgag

SEQ ID NO: 106 - DNA, 130 bp, Artificial Sequence
  Description of Artificial Sequence: Synthetic polynucleotide
ctcttagggtcctggtggggcccagggcagatgggccccagtgtgactgcctgcatccgtcctcgcagggaggtggactggttttccatggcgagcgtcatcttcctactgctgttcgcccccttcatcg

SEQ ID NO: 107 - DNA, 253 bp, Artificial Sequence
  Description of Artificial Sequence: Synthetic polynucleotide
tcgtcggcagcgtcagatgtgtataagagacagggtatttctgttcagatcactaaactcaagaatcagcaattctctgaggctttcttttaaatatacataaggaactttcggagtgaagggagagtttgtcaataacttgatgcatgtgaaggggagataaaaaggttgctatttttcatcaacatattttgatttggctttctataattgatgggcctgtctcttatacacatctccgagcccacgagac

SEQ ID NO: 108 - DNA, 930 bp, Artificial Sequence
  Description of Artificial Sequence: Synthetic polynucleotide
gagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacacatatgtcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagc

SEQ ID NO: 109 - DNA, 1203 bp, Artificial Sequence
  Description of Artificial Sequence: Synthetic polynucleotide
ctttccagcctttggaattgtatggacccaaaggaatgaaggacctttttaaaaaagatttttttttttttgtcaagactaatgaaaggtaaacagttttccactttataaagtaaggaattataaaaagaaactagaaatcatggtcagtcaacaacttagaaaaaaagataaaggcttaaagggcagctggggccttcccaccatctgggggtatgacctattgtcacagctcccatttcgccatagaaccatggggacttcgtgcagggtgagtatcctctccgacctggaactggggaaaccactggccttggtggttgtgaaagacctacctccgctcatattctgagctctgggccttccatgggggccacagatagtgccaccagttaatcaactacagtagagcaggcatgttgagtggcttccctggccgcaaggagggcccgtgctaggagctaatgccttctgtcatggggtactggtgggtttgagcaacagttctcccacacagagcctcttagggtcctggtggggcccagggcagatgggccccagtgtgactgcctgcatccgtcctcgcagggaggtggactggttttgaattccactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccaggtcagcagcccctgccctggggttgggacacagcaggtggggagcgtgccctcctgctggggtagtccttccatttgtctgggacatggatcctggctcaggttgacatctgggttcccgggacccagcagggcattccctggactctgacatgttcagattcatcctcagctgtaaggcaggaggcacctgtcacatcagcgtttgatacaccttcacggcatgcctgcatgcagttgctgggcacgcccagctctgcagggacaagctgaggataggagcaaaaccccgtgggagggcagtgctgtcctgaggaagccccattgtcagcaggagtcacgccttgcaccaggtctggaaaggagcatctcagtccccaaagggac

SEQ ID NO: 110 - DNA, 21 bp, Artificial Sequence
  Description of Artificial Sequence: Synthetic primer
gatgcttagaacagtgattgg

SEQ ID NO: 111 - DNA, 21 bp, Artificial Sequence
  Description of Artificial Sequence: Synthetic primer
ccaaagaattcctggaaggtg

SEQ ID NO: 112 - DNA, 27 bp, Artificial Sequence
  Description of Artificial Sequence: Synthetic primer
ggaaaggtggtgtctgttatttgaggg

SEQ ID NO: 113 - DNA, 25 bp, Artificial Sequence
  Description of Artificial Sequence: Synthetic primer
cctgtctctttctagcaccgtttcc

SEQ ID NO: 114 - DNA, 10 bp, Artificial Sequence
  Description of Artificial Sequence: Synthetic oligonucleotide
gcggccgcac

SEQ ID NO: 115 - DNA, 10 bp, Artificial Sequence
  Description of Artificial Sequence: Synthetic oligonucleotide
gtgcggccgc

SEQ ID NO: 116 - DNA, 17 bp, Artificial Sequence
  Description of Artificial Sequence: Synthetic oligonucleotide
gcggccgcacacgctgg

SEQ ID NO: 117 - DNA, 17 bp, Artificial Sequence
  Description of Artificial Sequence: Synthetic oligonucleotide
ccagcgtgtgcggccgc

SEQ ID NO: 118 - DNA, 9 bp, Artificial Sequence
  Description of Artificial Sequence: Synthetic oligonucleotide
gcggccgca

SEQ ID NO: 119 - DNA, 9 bp, Artificial Sequence
  Description of Artificial Sequence: Synthetic oligonucleotide
tgcggccgc

SEQ ID NO: 120 - DNA, 16 bp, Artificial Sequence
  Description of Artificial Sequence: Synthetic oligonucleotide
gcggccgcaccgctgg

SEQ ID NO: 121 - DNA, 16 bp, Artificial Sequence
  Description of Artificial Sequence: Synthetic oligonucleotide
ccagcggtgcggccgc

SEQ ID NO: 122 - DNA, 22 bp, Artificial Sequence
  Description of Artificial Sequence: Synthetic oligonucleotide
ccagcgccatccgtgcggccgc

SEQ ID NO: 123 - DNA, 22 bp, Artificial Sequence
  Description of Artificial Sequence: Synthetic oligonucleotide
gcggccgcacggatcccgctgg

SEQ ID NO: 124 - DNA, 125 bp, Artificial Sequence
  Description of Artificial Sequence: Synthetic polynucleotide
agtggctggacccttcgctattgcaaggcgaagtggtgtcagacggcccgttaagcccggccgaaatgaccatggaagtggcgcagctgctgcgcgatgctggcccgtgggggcagatgttcccg

SEQ ID NO: 125 - protein, 42 aa, Artificial Sequence
  Description of Artificial Sequence: Synthetic polypeptide
EWLDPSLLQGEVVSDGPLSPAEMTMEVAQLLRDAGPWGQMFP

SEQ ID NO: 126 - DNA, 117 bp, Artificial Sequence
  Description of Artificial Sequence: Synthetic polynucleotide
agtggctggacccttcgctattgcaaggcgaagtggtgtcagacggcccgttaagcccggcccatggaagtggcgcagctgctgcgcgatgctggcccgtgggggcagatgttcccg

SEQ ID NO: 127 - DNA, 124 bp, Artificial Sequence
  Description of Artificial Sequence: Synthetic polynucleotide
ttggcgagctggttaccgagtggctggacccttcgctattgcaaggcgaagtggtgtcagacggcccgttaagcccggccgaaatgaccatggaagtggcgcagctgctgcgcgatgctggccc

SEQ ID NO: 128 - protein, 42 aa, Artificial Sequence
  Description of Artificial Sequence: Synthetic polypeptide
FGELVTEWLDPSLLQGEVVSDGPLSPAEMTMEVAQLLRDAGP

SEQ ID NO: 129 - DNA, 118 bp, Artificial Sequence
  Description of Artificial Sequence: Synthetic polynucleotide
ttggcgagctggttaccgagtggctggacccttcgctattgcaaggcgaagtggtgtcagacggcccgttaagcccggccgccatggaagtggcgcagctgctgcgcgatgctggccc

SEQ ID NO: 130 - DNA, 121 bp, Artificial Sequence
  Description of Artificial Sequence: Synthetic polynucleotide
ttggcgagctggttaccgagtggctggacccttcgctattgcaaggcgaagtggtgtcagacggcccgttaagcccggccgaaatgatggaagtggcgcagctgctgcgcgatgctggccc

SEQ ID NO: 131 - DNA, 110 bp, Artificial Sequence
  Description of Artificial Sequence: Synthetic polynucleotide
ttggcgagctggttaccgagtggctggacccttcgctattgcaaggcgaagtggtgtcagacggcccgttaagccatggaagtggcgcagctgctgcgcgatgctggccc

SEQ ID NO: 132 - DNA, 125 bp, Artificial Sequence
  Description of Artificial Sequence: Synthetic polynucleotide
ccgagtggctggacccttcgctattgcaaggcgaagtggtgtcagacggcccgttaagcccggccgaaatgaccatggaagtggcgcagctgctgcgcgatgctggcccgtgggggcagatgttc

SEQ ID NO: 133 - protein, 42 aa, Artificial Sequence
  Description of Artificial Sequence: Synthetic polypeptide
TEWLDPSLLQGEVVSDGPLSPAEMTMEVAQLLRDAGPWGQMF

SEQ ID NO: 134 - DNA, 126 bp, Artificial Sequence
  Description of Artificial Sequence: Synthetic polynucleotide
accgagtggctggacccttcgctattgcaaggcgaagtggtgtcagacggcccgttaagcccggccgaaatgaccatggaagtggcgcagctgctgcgcgatgctggcccgtgggggcagatgttc

SEQ ID NO: 135 - DNA, 101 bp, Artificial Sequence
  Description of Artificial Sequence: Synthetic polynucleotide
gatcgcggcgaaggtttcgtacacgatctgacgtcactggcgcgcgacgtagccactggcgtactggcccgttcaatggatctggacatctataaccttca

SEQ ID NO: 136 - DNA, 88 bp, Artificial Sequence
  Description of Artificial Sequence: Synthetic oligonucleotide
gatcgcggcgaaggtttcgtacacgatctgacgtcactggcgcgcgactactggcccgttcaatggatctggacatctataaccttca

SEQ ID NO: 137 - DNA, 93 bp, Artificial Sequence
  Description of Artificial Sequence: Synthetic oligonucleotide
gatcgcggcgaaggtttcgtacacgatctgacgtcactggcgcgcgacgtagctactggcccgttcaatggatctggacatctataaccttca

SEQ ID NO: 138 - DNA, 100 bp, Artificial Sequence
  Description of Artificial Sequence: Synthetic polynucleotide
gatcgcggcgaaggtttcgtacacgatctgacgtcactggcgcgcgacgtagccactggctactggcccgttcaatggatctggacatctataaccttca

SEQ ID NO: 139 - DNA, 96 bp, Artificial Sequence
  Description of Artificial Sequence: Synthetic oligonucleotide
gatcgcggcgaaggtttcgtacacgatctgacgtcactggcgcgcgacgtagccactactggcccgttcaatggatctggacatctataaccttca

SEQ ID NO: 140 - DNA, 99 bp, Artificial Sequence
  Description of Artificial Sequence: Synthetic oligonucleotide
gatcgcggcgaaggtttcgtacacgatctgacgtcactggcgcgcgacgtagccactggtactggcccgttcaatggatctggacatctataaccttca

SEQ ID NO: 141 - DNA, 94 bp, Artificial Sequence
  Description of Artificial Sequence: Synthetic oligonucleotide
gatcgcggcgaaggtttcgtacacgatctgacgtcactggcgcgcgacgtagcctactggcccgttcaatggatctggacatctataaccttca

SEQ ID NO: 142 - DNA, 93 bp, Artificial Sequence
  Description of Artificial Sequence: Synthetic oligonucleotide
gatcgcggcgaaggtttcgtacacgatctgacgtcactggcgcgcgacgtagccactggcccgttcaatggatctggacatctataaccttca

SEQ ID NO: 143 - DNA, 47 bp, Artificial Sequence
  Description of Artificial Sequence: Synthetic oligonucleotide
gatcgcggcgaaggtttcgtacacgatctggacatctataaccttca

SEQ ID NO: 144 - DNA, 90 bp, Artificial Sequence
  Description of Artificial Sequence: Synthetic oligonucleotide
gatcgcggcgaaggtttcgtacacgatctgacgtcactggcgcgcgacgttactggcccgttcaatggatctggacatctataaccttca

SEQ ID NO: 145 - DNA, 86 bp, Artificial Sequence
  Description of Artificial Sequence: Synthetic oligonucleotide
gatcgcggcgaaggtttcgtacacgatctgacgtcactggcgcgcgtactggcccgttcaatggatctggacatctataaccttca

SEQ ID NO: 146 - DNA, 85 bp, Artificial Sequence
  Description of Artificial Sequence: Synthetic oligonucleotide
gatcgcggcgaaggtttcgtacacgatctgacgtcactggcgcgctactggcccgttcaatggatctggacatctataaccttca

SEQ ID NO: 147 - DNA, 88 bp, Artificial Sequence
  Description of Artificial Sequence: Synthetic oligonucleotide
gatcgcggcgaaggtttcgtacacgatctgacgtcactggcgcgcgactactggcccgttcaatggatctggacatatataaccttca

SEQ ID NO: 148 - DNA, 124 bp, Artificial Sequence
  Description of Artificial Sequence: Synthetic polynucleotide
gttaccgagtggctggacccttcgctattgcaaggcgaagtggtgtcagacggcccgttaagcccggccgaaatgaccatggaagtggcgcagctgctgcgcgatgctggcccgtgggggcaga

SEQ ID NO: 149 - DNA, 45 bp, Artificial Sequence
  Description of Artificial Sequence: Synthetic oligonucleotide
agtgccggcgattgtcgtgcggcgattgtcgtgcggaatccgggg

SEQ ID NO: 150 - DNA, 54 bp, Arabidopsis thaliana
tgggtttggagatgtttacaaagcgattttgaaagatggaagcgcggtggctat

SEQ ID NO: 151 - DNA, 56 bp, Arabidopsis thaliana
gctggggtgaaactaaactggtccacacggcggaagattgcgataggatcagctag

SEQ ID NO: 152 - DNA, 49 bp, Artificial Sequence
  Description of Artificial Sequence: Synthetic oligonucleotide
gctggggtgaaactaaaacacggcggaagattgcgataggatcagctag

SEQ ID NO: 153 - DNA, 76 bp, Artificial Sequence
  Description of Artificial Sequence: Synthetic oligonucleotide
tgggtttggagatgtttacaaagcgattttgaaagatggaagcgacacggcggaagattgcgataggatcagctag

SEQ ID NO: 154 - DNA, 77 bp, Artificial Sequence
  Description of Artificial Sequence: Synthetic oligonucleotide
tgggtttggagatgtttacaaagcgattttgaaagatggaagcgcacacggcggaagattgcgataggatcagctag

SEQ ID NO: 155 - DNA, 139 bp, Artificial Sequence
  Description of Artificial Sequence: Synthetic polynucleotide
tgggtttggagatgtttacaaagcgattttgaaagatggaagcgaaatagcaagttaaaataaggctagtccgttatcaacttgaaaaagtggcaccgagtcggtgcacacggcggaagattgcgataggatcagctag

SEQ ID NO: 156 - DNA, 80 bp, Arabidopsis thaliana
gtgggtttggagatgtttacaaagcgattttgaaagatggaagcgcggtggctatcaagaaactgattcatgttagcggt

SEQ ID NO: 157 - DNA, 81 bp, Artificial Sequence
  Description of Artificial Sequence: Synthetic oligonucleotide
gtgggtttggagatgtttacaaagcgattttgaaagatggaagcggcggtggctatcaagaaactgattcatgttagcggt

SEQ ID NO: 158 - DNA, 78 bp, Artificial Sequence
  Description of Artificial Sequence: Synthetic oligonucleotide
gtgggtttggagatgtttacaaagcgattttgaaagatggaagcggtggctatcaagaaactgattcatgttagcggt

SEQ ID NO: 159 - DNA, 81 bp, Artificial Sequence
  Description of Artificial Sequence: Synthetic oligonucleotide
gtgggtttggagatgtttacaaagcgattttgaaagatggaagcgtcggtggctatcaagaaactgattcatgttagcggt

SEQ ID NO: 160 - DNA, 80 bp, Arabidopsis thaliana
acggtgcagcatttctttaccacgggaagtattacccgttgggtgttgctcctagtgaagttcagataaaagatgttgtg

SEQ ID NO: 161 - DNA, 79 bp, Artificial Sequence
  Description of Artificial Sequence: Synthetic oligonucleotide
acggtgcagcatttctttaccacgggaagtattacccgttggtgttgctcctagtgaagttcagataaaagatgttgtg

SEQ ID NO: 162 - DNA, 81 bp, Artificial Sequence
  Description of Artificial Sequence: Synthetic oligonucleotide
acggtgcagcatttctttaccacgggaagtattacccgttagggtgttgctcctagtgaagttcagataaaagatgttgtg

SEQ ID NO: 163 - DNA, 81 bp, Artificial Sequence
  Description of Artificial Sequence: Synthetic oligonucleotide
acggtgcagcatttctttaccacgggaagtattacccgtttgggtgttgctcctagtgaagttcagataaaagatgttgtg

SEQ ID NO: 164 - DNA, 79 bp, Artificial Sequence
  Description of Artificial Sequence: Synthetic oligonucleotide
acggtgcagcatttctttaccacgggaagtattacccgtgggtgttgctcctagtgaagttcagataaaagatgttgtg

SEQ ID NO: 165 - DNA, 23 bp, Artificial Sequence
  Description of Artificial Sequence: Synthetic oligonucleotide
gaattcgagcaatacccaactgg

SEQ ID NO: 166 - DNA, 23 bp, Artificial Sequence
  Description of Artificial Sequence: Synthetic oligonucleotide
aactgggaacatcacccaatagg

SEQ ID NO: 167 - DNA, 23 bp, Artificial Sequence
  Description of Artificial Sequence: Synthetic oligonucleotide
caccaggagcaatatcaaactgg

SEQ ID NO: 168 - DNA, 23 bp, Arabidopsis thaliana
cactaggagcaacacccaacggg

SEQ ID NO: 169 - DNA, 23 bp, Artificial Sequence
  Description of Artificial Sequence: Synthetic oligonucleotide
tttggaaaagggtagcgcggtgg

SEQ ID NO: 170 - DNA, 23 bp, Artificial Sequence
  Description of Artificial Sequence: Synthetic oligonucleotide
tttgaaaaagagaagcgtggtgg

SEQ ID NO: 171 - DNA, 23 bp, Artificial Sequence
  Description of Artificial Sequence: Synthetic oligonucleotide
tttggaagatggaagctatgtgg

SEQ ID NO: 172 - DNA, 23 bp, Artificial Sequence
  Description of Artificial Sequence: Synthetic oligonucleotide
attaaaggttggaagcgcggcgg

SEQ ID NO: 173 - DNA, 23 bp, Artificial Sequence
  Description of Artificial Sequence: Synthetic oligonucleotide
tttgaaggatggattcgctgcgg

SEQ ID NO: 174 - DNA, 23 bp, Artificial Sequence
  Description of Artificial Sequence: Synthetic oligonucleotide
tttgaaacatggaagcacgaagg

SEQ ID NO: 175 - DNA, 23 bp, Arabidopsis thaliana
tttgaaagatggaagcgcggtgg

SEQ ID NO: 176 - DNA, 23 bp, Artificial Sequence
  Description of Artificial Sequence: Synthetic oligonucleotide
tgtaacaaaactggtcaaccagg

SEQ ID NO: 177 - DNA, 23 bp, Artificial Sequence
  Description of Artificial Sequence: Synthetic oligonucleotide
tagatctgaactggtccacaggg

SEQ ID NO: 178 - DNA, 23 bp, Artificial Sequence
  Description of Artificial Sequence: Synthetic oligonucleotide
tgtaagtaaattggtccgcatgg

SEQ ID NO: 179 - DNA, 23 bp, Artificial Sequence
  Description of Artificial Sequence: Synthetic oligonucleotide
tgaaactagactggtcaacaagg

SEQ ID NO: 180 - DNA, 23 bp, Arabidopsis thaliana
tgaaactaaactggtccacacgg

SEQ ID NO: 181 - DNA, 78 bp, Arabidopsis thaliana
tggttgatcccgtctgcatcgtccaagcgcacagtggcccggcctacgacgtcaggttctacccggattcgcagcagc

SEQ ID NO: 182 - DNA, 60 bp, Artificial Sequence
  Description of Artificial Sequence: Synthetic oligonucleotide
tggttgatcccgtctgcatcgtccaagcgcacagtggcccggcctacgacgtcaggttct

SEQ ID NO: 183 - DNA, 18 bp, Artificial Sequence
  Description of Artificial Sequence: Synthetic oligonucleotide
acccggattcgcagcagc

SEQ ID NO: 184 - DNA, 49 bp, Artificial Sequence
  Description of Artificial Sequence: Synthetic oligonucleotide
tggttgatcccgtctgcatcgtccaagcgctacccggattcgcagcagc

SEQ ID NO: 185 - DNA, 113 bp, Arabidopsis thaliana
caggaaccttgctctagcactggtcacctccacaaagctcaagcccagctaccttggcgacattgagaagattgcactgcatatagttgggtcatggcatggcaagagcaagg

SEQ ID NO: 186 - DNA, 112 bp, Artificial Sequence
  Description of Artificial Sequence: Synthetic polynucleotide
caggaaccttgctctagcactggtcacctccacaaagctcaagcccagctaccttggcgacattgagaagattgcactgcatatagttgggtcatgcatggcaagagcaagg

SEQ ID NO: 187 - DNA, 54 bp, Arabidopsis thaliana
aatttttcgggttttaaagcatcacagtgatgctcgtcaaaggatgcctctcat

SEQ ID NO: 188 - DNA, 23 bp, Arabidopsis thaliana
atcacagtgatgctcgtcaaagg

SEQ ID NO: 189 - DNA, 24 bp, Artificial Sequence
  Description of Artificial Sequence: Synthetic oligonucleotide
atcacagtgatgctcgttcaaagg

SEQ ID NO: 190 - DNA, 22 bp, Artificial Sequence
  Description of Artificial Sequence: Synthetic oligonucleotide
atcacagtgatgctcgcaaagg

SEQ ID NO: 191 - DNA, 24 bp, Artificial Sequence
  Description of Artificial Sequence: Synthetic oligonucleotide
atcacagtgatgctcgtacaaagg

SEQ ID NO: 192 - DNA, 24 bp, Artificial Sequence
  Description of Artificial Sequence: Synthetic oligonucleotide
atcacagtgatgctcgtgcaaagg

SEQ ID NO: 193 - DNA, 20 bp, Artificial Sequence
  Description of Artificial Sequence: Synthetic oligonucleotide
atcacagtgatgctcaaagg

SEQ ID NO: 194 - DNA, 24 bp, Artificial Sequence
  Description of Artificial Sequence: Synthetic oligonucleotide
atcacagtgatgctcgtccaaagg

SEQ ID NO: 195 - DNA, 14 bp, Artificial Sequence
  Description of Artificial Sequence: Synthetic oligonucleotide
atcacagtcaaagg

SEQ ID NO: 196 - DNA, 21 bp, Artificial Sequence
  Description of Artificial Sequence: Synthetic oligonucleotide
atcacagtgatgctcgtaagg

SEQ ID NO: 197 - DNA, 16 bp, Artificial Sequence
  Description of Artificial Sequence: Synthetic oligonucleotide
atcacagtgtcaaagg

SEQ ID NO: 198 - DNA, 23 bp, Artificial Sequence
  Description of Artificial Sequence: Synthetic oligonucleotide
atcacagtgcggctcgtcaaggg

SEQ ID NO: 199 - DNA, 23 bp, Artificial Sequence
  Description of Artificial Sequence: Synthetic oligonucleotide
cacacagtgatgttcgtcaaggg

SEQ ID NO: 200 - DNA, 23 bp, Artificial Sequence
  Description of Artificial Sequence: Synthetic oligonucleotide
ataccagggatgctcgtcaatgg

SEQ ID NO: 201 - DNA, 23 bp, Artificial Sequence
  Description of Artificial Sequence: Synthetic oligonucleotide
atcatagtgatgctcatgaaggg

SEQ ID NO: 202 - DNA, 23 bp, Artificial Sequence
  Description of Artificial Sequence: Synthetic oligonucleotide
atcacattgatgctctacatagg

SEQ ID NO: 203 - DNA, 23 bp, Artificial Sequence
  Description of Artificial Sequence: Synthetic oligonucleotide
ataacagagacgatcgtcaaagg

SEQ ID NO: 204 - DNA, 58 bp, Artificial Sequence
  Description of Artificial Sequence: Synthetic oligonucleotide
cactaggagcaacacctgatgatcaggtccttcttcacctccttgtagccctaacggg

SEQ ID NO: 205 - DNA, 35 bp, Artificial Sequence
  Description of Artificial Sequence: Synthetic oligonucleotide
gatgatcaggtccttcttcacctccttgtagccct

SEQ ID NO: 206 - DNA, 110 bp, Homo sapiens
cactttttatttatgcacagggtggaacaagatggattatcaagtgtcaagtccaatctatgacatcaattattatacatcggagccctgccaaaaaatcaatgtgaagc

SEQ ID NO: 207 - DNA, 106 bp, Homo sapiens
ctggtggggcccagggcagatgggccccagtgtgactgcctgcatccgtcctcgcagggaggtggactggttttcactggcgagcgtcatcttcctactgctgttc

SEQ ID NO: 208 - DNA, 104 bp, Homo sapiens
aattctctgaggctttcttttaaatatacataaggaactttcggagtgaagggagagtttgtcaataacttgatgcatgtgaaggggagataaaaaggttgcta

SEQ ID NO: 209 - DNA, 24 bp, Artificial Sequence
  Description of Artificial Sequence: Synthetic oligonucleotide
ggagtgaagggagagtttgtcaat

SEQ ID NO: 210 - DNA, 106 bp, Homo sapiens
ggggccgtttccctcactcctgctcggtgaatttggctcagcaggcacctgcctcagctgctcacttgagcctctgggtctagaaccctctggggaccgtttgagg

SEQ ID NO: 211 - DNA, 20 bp, Artificial Sequence
  Description of Artificial Sequence: Synthetic oligonucleotide
gctcagcaggcacctgcctc

SEQ ID NO: 212 - DNA, 23 bp, Artificial Sequence
  Description of Artificial Sequence: Synthetic oligonucleotide
  modified_base (21)..(21): a, c, t, g, unknown or other
tgacatcaattattatacatngg

SEQ ID NO: 213 - DNA, 23 bp, Artificial Sequence
  Description of Artificial Sequence: Synthetic oligonucleotide
tgacatcatttgttatagaatgg

SEQ ID NO: 214 - DNA, 23 bp, Artificial Sequence
  Description of Artificial Sequence: Synthetic oligonucleotide
tgacataaattcttaaacttagg

SEQ ID NO: 215 - DNA, 23 bp, Artificial Sequence
  Description of Artificial Sequence: Synthetic oligonucleotide
tgaaatgaattattaaacattgg

SEQ ID NO: 216 - DNA, 23 bp, Artificial Sequence
  Description of Artificial Sequence: Synthetic oligonucleotide
tgacatcattcattctacctggg

SEQ ID NO: 217 - DNA, 23 bp, Artificial Sequence
  Description of Artificial Sequence: Synthetic oligonucleotide
tgtcttttattattatacatagg

SEQ ID NO: 218 - DNA, 23 bp, Artificial Sequence
  Description of Artificial Sequence: Synthetic oligonucleotide
tgacttccattcttatccatggg

SEQ ID NO: 219 - DNA, 23 bp, Artificial Sequence
  Description of Artificial Sequence: Synthetic oligonucleotide
tgagagcaattgttaaacattgg

SEQ ID NO: 220 - DNA, 23 bp, Artificial Sequence
  Description of Artificial Sequence: Synthetic oligonucleotide
tgacatcaagaaatatacagagg

SEQ ID NO: 221 - DNA, 23 bp, Artificial Sequence
  Description of Artificial Sequence: Synthetic oligonucleotide
tgacataaatgatcatccatggg

SEQ ID NO: 222 - DNA, 23 bp, Artificial Sequence
  Description of Artificial Sequence: Synthetic oligonucleotide
tgacattaattataatgcagtgg

SEQ ID NO: 223 - DNA, 23 bp, Artificial Sequence
  Description of Artificial Sequence: Synthetic oligonucleotide
tcacctctattattttacattgg

SEQ ID NO: 224 - DNA, 23 bp, Artificial Sequence
  Description of Artificial Sequence: Synthetic oligonucleotide
tgaaatcaattcatatccattgg

SEQ ID NO: 225 - DNA, 23 bp, Artificial Sequence
  Description of Artificial Sequence: Synthetic oligonucleotide
tgaaataaattattatgaattgg

SEQ ID NO: 226 - DNA, 23 bp, Artificial Sequence
  Description of Artificial Sequence: Synthetic oligonucleotide
tgacattaatttttatgtattgg

SEQ ID NO: 227 - DNA, 23 bp, Artificial Sequence
  Description of Artificial Sequence: Synthetic oligonucleotide
tgccatgaatttttatacactgg

SEQ ID NO: 228 - DNA, 23 bp, Artificial Sequence
  Description of Artificial Sequence: Synthetic oligonucleotide
tgacatttagtcttatacattgg

SEQ ID NO: 229 - DNA, 23 bp, Artificial Sequence
  Description of Artificial Sequence: Synthetic oligonucleotide
ttacatcaattagtatattttgg

SEQ ID NO: 230 - DNA, 23 bp, Artificial Sequence
  Description of Artificial Sequence: Synthetic oligonucleotide
taacttcaattattatactaagg

SEQ ID NO: 231 - DNA, 23 bp, Artificial Sequence
  Description of Artificial Sequence: Synthetic oligonucleotide
acacatgcattattatacatagg

SEQ ID NO: 232 - DNA, 23 bp, Artificial Sequence
  Description of Artificial Sequence: Synthetic oligonucleotide
taacatcattgataatacatggg

SEQ ID NO: 233 - DNA, 23 bp, Artificial Sequence
  Description of Artificial Sequence: Synthetic oligonucleotide
tgacattatttgttatacaaggg

SEQ ID NO: 234 - DNA, 23 bp, Artificial Sequence
  Description of Artificial Sequence: Synthetic oligonucleotide
tgacatcaataattaaaaagggg

SEQ ID NO: 235 - DNA, 23 bp, Artificial Sequence
  Description of Artificial Sequence: Synthetic oligonucleotide
ttacatcaattatgatacagtgg

SEQ ID NO: 236 - DNA, 23 bp, Artificial Sequence
  Description of Artificial Sequence: Synthetic oligonucleotide
ttccatcaattattctaaattgg

SEQ ID NO: 237 - DNA, 23 bp, Artificial Sequence
  Description of Artificial Sequence: Synthetic oligonucleotide
ggacatcaattattggacttagg

SEQ ID NO: 238 - DNA, 23 bp, Artificial Sequence
  Description of Artificial Sequence: Synthetic oligonucleotide
tgacattaactattattaatggg

SEQ ID NO: 239 - DNA, 23 bp, Artificial Sequence
  Description of Artificial Sequence: Synthetic oligonucleotide
tgagataaattatactacattgg

SEQ ID NO: 240 - DNA, 23 bp, Artificial Sequence
  Description of Artificial Sequence: Synthetic oligonucleotide
tgacagccattaatacacatagg

SEQ ID NO: 241 - DNA, 23 bp, Artificial Sequence
  Description of Artificial Sequence: Synthetic oligonucleotide
tgacctccattattataccaggg

SEQ ID NO: 242 - DNA, 23 bp, Artificial Sequence
  Description of Artificial Sequence: Synthetic oligonucleotide
tgacatcatttcctttacatggg

SEQ ID NO: 243 - DNA, 23 bp, Artificial Sequence
  Description of Artificial Sequence: Synthetic oligonucleotide
tgacactaattattatgcttggg

SEQ ID NO: 244 - DNA, 23 bp, Artificial Sequence
  Description of Artificial Sequence: Synthetic oligonucleotide
tgccatcaattattaaatagtgg

SEQ ID NO: 245 - DNA, 23 bp, Artificial Sequence
  Description of Artificial Sequence: Synthetic oligonucleotide
tcaaatcaatgataatacattgg

SEQ ID NO: 246 - DNA, 23 bp, Artificial Sequence
  Description of Artificial Sequence: Synthetic oligonucleotide
gaacatgaattaatatacattgg

SEQ ID NO: 247 - DNA, 23 bp, Artificial Sequence
  Description of Artificial Sequence: Synthetic oligonucleotide
tgaaaataactattatacatagg

SEQ ID NO: 248 - DNA, 23 bp, Artificial Sequence
  Description of Artificial Sequence: Synthetic oligonucleotide
tgatataaattattatatatggg

SEQ ID NO: 249 - DNA, 23 bp, Artificial Sequence
  Description of Artificial Sequence: Synthetic oligonucleotide
tcacagcaataaatatacatggg

SEQ ID NO: 250 - DNA, 23 bp, Artificial Sequence
  Description of Artificial Sequence: Synthetic oligonucleotide
agaaatcaattattagaaatagg

SEQ ID NO: 251 - DNA, 23 bp, Artificial Sequence
  Description of Artificial Sequence: Synthetic oligonucleotide
tgtcaccaattattttacctggg

SEQ ID NO: 252 - DNA, 23 bp, Artificial Sequence
  Description of Artificial Sequence: Synthetic oligonucleotide
tgaaatcaattatcatagatcgg

SEQ ID NO: 253 - DNA, 23 bp, Artificial Sequence
  Description of Artificial Sequence: Synthetic oligonucleotide
tgaaatagattattatagatcgg

SEQ ID NO: 254 - DNA, 23 bp, Artificial Sequence
  Description of Artificial Sequence: Synthetic oligonucleotide
tgacatcagttactgtatatagg

SEQ ID NO: 255 - DNA, 23 bp, Artificial Sequence
  Description of Artificial Sequence: Synthetic oligonucleotide
tgatttctattattatagattgg

SEQ ID NO: 256 - DNA, 23 bp, Artificial Sequence
  Description of Artificial Sequence: Synthetic oligonucleotide
tgatatgaatttttatactttgg

SEQ ID NO: 257 - DNA, 23 bp, Artificial Sequence
  Description of Artificial Sequence: Synthetic oligonucleotide
tgacataaaggattatagatggg

SEQ ID NO: 258 - DNA, 23 bp, Artificial Sequence
  Description of Artificial Sequence: Synthetic oligonucleotide
tgacataaattattataagtagg

SEQ ID NO: 259 - DNA, 23 bp, Artificial Sequence
  Description of Artificial Sequence: Synthetic oligonucleotide
tgagaacaattattttatattgg

SEQ ID NO: 260 - DNA, 23 bp, Artificial Sequence
  Description of Artificial Sequence: Synthetic oligonucleotide
tgacatcaaaaattaaacacagg

SEQ ID NO: 261 - DNA, 23 bp, Artificial Sequence
  Description of Artificial Sequence: Synthetic oligonucleotide
tgacagcaatttgtagacatggg

SEQ ID NO: 262 - DNA, 23 bp, Artificial Sequence
  Description of Artificial Sequence: Synthetic oligonucleotide
taagaacaattattatagatagg

SEQ ID NO: 263 - DNA, 23 bp, Artificial Sequence
  Description of Artificial Sequence: Synthetic oligonucleotide
taacttcaataattagacattgg

SEQ ID NO: 264 - DNA, 23 bp, Artificial Sequence
  Description of Artificial Sequence: Synthetic oligonucleotide
tgacttcaaatattagaaattgg

SEQ ID NO: 265 - DNA, 23 bp, Artificial Sequence
  Description of Artificial Sequence: Synthetic oligonucleotide
agacattacttattatacacagg

SEQ ID NO: 266 - DNA, 23 bp, Artificial Sequence
  Description of Artificial Sequence: Synthetic oligonucleotide
tgacagaaattcttagacatagg

SEQ ID NO: 267 - DNA, 23 bp, Artificial Sequence
  Description of Artificial Sequence: Synthetic oligonucleotide
tgacataaattattctacatggg

SEQ ID NO: 268 - DNA, 23 bp, Artificial Sequence
  Description of Artificial Sequence: Synthetic oligonucleotide
taccatgaatttttatacattgg

SEQ ID NO: 269 - DNA, 23 bp, Artificial Sequence
  Description of Artificial Sequence: Synthetic oligonucleotide
ttacataaattattacatatagg

SEQ ID NO: 270 - DNA, 23 bp, Artificial Sequence
  Description of Artificial Sequence: Synthetic oligonucleotide
tgaaattaataattatacctagg

SEQ ID NO: 271 - DNA, 23 bp, Artificial Sequence
  Description of Artificial Sequence: Synthetic oligonucleotide
tgataaaagttattatacattgg

SEQ ID NO: 272 - DNA, 23 bp, Artificial Sequence
  Description of Artificial Sequence: Synthetic oligonucleotide
tgacaacaattctaatgcattgg

SEQ ID NO: 273 - DNA, 23 bp, Artificial Sequence
  Description of Artificial Sequence: Synthetic oligonucleotide
tgtcatgaattattacacaatgg

SEQ ID NO: 274 - DNA, 23 bp, Artificial Sequence
  Description of Artificial Sequence: Synthetic oligonucleotide
tgacctcatttattaaacatagg

SEQ ID NO: 275 - DNA, 23 bp, Artificial Sequence
  Description of Artificial Sequence: Synthetic oligonucleotide
tgaaaccaattagtagacatggg

SEQ ID NO: 276 - DNA, 23 bp, Artificial Sequence
  Description of Artificial Sequence: Synthetic oligonucleotide
taacatcaataactattcattgg

SEQ ID NO: 277 - DNA, 23 bp, Artificial Sequence
  Description of Artificial Sequence: Synthetic oligonucleotide
  modified_base (21)..(21): a, c, t, g, unknown or other
ggaggtggactggttttcacngg

SEQ ID NO: 278 - DNA, 23 bp, Artificial Sequence
  Description of Artificial Sequence: Synthetic oligonucleotide
ggatggggactggttgtcagagg

SEQ ID NO: 279 - DNA, 23 bp, Artificial Sequence
  Description of Artificial Sequence: Synthetic oligonucleotide
tgaggtggactcattctcactgg

SEQ ID NO: 280 - DNA, 23 bp, Artificial Sequence
  Description of Artificial Sequence: Synthetic oligonucleotide
ggaggtggagtgggcttgactgg

SEQ ID NO: 281 - DNA, 23 bp, Artificial Sequence
  Description of Artificial Sequence: Synthetic oligonucleotide
tgaggggggctggtattcactgg

SEQ ID NO: 282 - DNA, 23 bp, Artificial Sequence
  Description of Artificial Sequence: Synthetic oligonucleotide
ggaggctggctggtgttcacggg

SEQ ID NO: 283 - DNA, 23 bp, Artificial Sequence
  Description of Artificial Sequence: Synthetic oligonucleotide
gaagatggactgcttttcagagg

SEQ ID NO: 284 - DNA, 23 bp, Artificial Sequence
  Description of Artificial Sequence: Synthetic oligonucleotide
tgaggggtactggctttcactgg

SEQ ID NO: 285 - DNA, 23 bp, Artificial Sequence
  Description of Artificial Sequence: Synthetic oligonucleotide
ggagctggtctggtttgcagggg

SEQ ID NO: 286 - DNA, 23 bp, Artificial Sequence
  Description of Artificial Sequence: Synthetic oligonucleotide
gcaggttttctggttttcacagg

SEQ ID NO: 287 - DNA, 23 bp, Artificial Sequence
  Description of Artificial Sequence: Synthetic oligonucleotide
gtaagtggactggggttcacagg

SEQ ID NO: 288 - DNA, 23 bp, Artificial Sequence
  Description of Artificial Sequence: Synthetic oligonucleotide
gggagcgggctggttttcacagg

SEQ ID NO: 289 - DNA, 23 bp, Artificial Sequence
  Description of Artificial Sequence: Synthetic oligonucleotide
ggaggtggccctgtttgcacagg

SEQ ID NO: 290 - DNA, 23 bp, Artificial Sequence
  Description of Artificial Sequence: Synthetic oligonucleotide
ggaaatgtactgggtttcactgg

SEQ ID NO: 291 - DNA, 23 bp, Artificial Sequence
  Description of Artificial Sequence: Synthetic oligonucleotide
ggaggtggacagactttccctgg

SEQ ID NO: 292 - DNA, 23 bp, Artificial Sequence
  Description of Artificial Sequence: Synthetic oligonucleotide
tggggtggactgtttttcccagg

SEQ ID NO: 293 - DNA, 23 bp, Artificial Sequence
  Description of Artificial Sequence: Synthetic oligonucleotide
gagggtggactgtttttcaatgg

SEQ ID NO: 294 - DNA, 23 bp, Artificial Sequence
  Description of Artificial Sequence: Synthetic oligonucleotide
ggaggtggaattgtcttcccagg

SEQ ID NO: 295 - DNA, 23 bp, Artificial Sequence
  Description of Artificial Sequence: Synthetic oligonucleotide
ggaggtggccagggtctcacagg

SEQ ID NO: 296 - DNA, 23 bp, Artificial Sequence
  Description of Artificial Sequence: Synthetic oligonucleotide
ggaggtggagtgatcgtcactgg

SEQ ID NO: 297 - DNA, 23 bp, Artificial Sequence
  Description of Artificial Sequence: Synthetic oligonucleotide
ggaggtgcagttgttttcacagg

SEQ ID NO: 298 - DNA, 23 bp, Artificial Sequence
  Description of Artificial Sequence: Synthetic oligonucleotide
agaagtggactgtatttcacagg

SEQ ID NO: 299 - DNA, 23 bp, Artificial Sequence
  Description of Artificial Sequence: Synthetic oligonucleotide
agaggtggagtgtttttcatggg

SEQ ID NO: 300 - DNA, 23 bp, Artificial Sequence
  Description of Artificial Sequence: Synthetic oligonucleotide
gagggtggaatggttttcagggg

SEQ ID NO: 301 - DNA, 23 bp, Artificial Sequence
  Description of Artificial Sequence: Synthetic oligonucleotide
ggaggtgtattagttttctctgg

SEQ ID NO: 302 - DNA, 23 bp, Artificial Sequence
  Description of Artificial Sequence: Synthetic oligonucleotide
ggatgtggactggatttcctagg

SEQ ID NO: 303 - DNA, 23 bp, Artificial Sequence
  Description of Artificial Sequence: Synthetic oligonucleotide
ggagggggcctggctttcccagg

SEQ ID NO: 304 - DNA, 23 bp, Artificial Sequence
  Description of Artificial Sequence: Synthetic oligonucleotide
gtagggggacttgttttcaatgg

SEQ ID NO: 305 - DNA, 23 bp, Artificial Sequence
  Description of Artificial Sequence: Synthetic oligonucleotide
ggaggtggtatggttgtcactgg

SEQ ID NO: 306 - DNA, 23 bp, Artificial Sequence
  Description of Artificial Sequence: Synthetic oligonucleotide
gtaacaggactggttttcacagg

SEQ ID NO: 307 - DNA, 23 bp, Artificial Sequence
  Description of Artificial Sequence: Synthetic oligonucleotide
ggaggtggaagggtcttcccagg

SEQ ID NO: 308 - DNA, 23 bp, Artificial Sequence
  Description of Artificial Sequence: Synthetic oligonucleotide
gggagtgggctggttatcacagg

SEQ ID NO: 309 - DNA, 23 bp, Artificial Sequence
  Description of Artificial Sequence: Synthetic oligonucleotide
ggagggagccaggttttcacagg

SEQ ID NO: 310 - DNA, 23 bp, Artificial Sequence
  Description of Artificial Sequence: Synthetic oligonucleotide
ggaggtgaagagcttttcacagg

SEQ ID NO: 311 - DNA, 23 bp, Artificial Sequence
  Description of Artificial Sequence: Synthetic oligonucleotide
agaggtagactcgttatcacagg

SEQ ID NO: 312 - DNA, 23 bp, Artificial Sequence
  Description of Artificial Sequence: Synthetic oligonucleotide
aaacgtggacttgttttcacagg

SEQ ID NO: 313 - DNA, 23 bp, Artificial Sequence
  Description of Artificial Sequence: Synthetic oligonucleotide
ggaggtgaagtggcttgcacagg

SEQ ID NO: 314 - DNA, 23 bp, Artificial Sequence
  Description of Artificial Sequence: Synthetic oligonucleotide
gaagatggactggtttgcaaggg

SEQ ID NO: 315 - DNA, 23 bp, Artificial Sequence
  Description of Artificial Sequence: Synthetic oligonucleotide
gcaggtggcctgggtttcagagg

SEQ ID NO: 316 - DNA, 23 bp, Artificial Sequence
  Description of Artificial Sequence: Synthetic oligonucleotide
tgagatggactggtcttcatggg

SEQ ID NO: 317 - DNA, 23 bp, Artificial Sequence
  Description of Artificial Sequence: Synthetic oligonucleotide
gtaggttgattggttttctctgg

SEQ ID NO: 318 - DNA, 23 bp, Artificial Sequence
  Description of Artificial Sequence: Synthetic oligonucleotide
tgagatggagtggttttcccagg

SEQ ID NO: 319 - DNA, 23 bp, Artificial Sequence
  Description of Artificial Sequence: Synthetic oligonucleotide
ggaggtggccgggtgttcagagg

SEQ ID NO: 320 - DNA, 23 bp, Artificial Sequence
  Description of Artificial Sequence: Synthetic oligonucleotide
ggaggtggactgttttcccaggg

SEQ ID NO: 321 - DNA, 23 bp, Artificial Sequence
  Description of Artificial Sequence: Synthetic oligonucleotide
ggaggtcggctggatttcagtgg

SEQ ID NO: 322 - DNA, 23 bp, Artificial Sequence
  Description of Artificial Sequence: Synthetic oligonucleotide
gcaggtgggctggtctccaccgg

SEQ ID NO: 323 - DNA, 23 bp, Artificial Sequence
  Description of Artificial Sequence: Synthetic oligonucleotide
ggaggtgggcttgttttcttcgg

SEQ ID NO: 324 - DNA, 23 bp, Artificial Sequence
  Description of Artificial Sequence: Synthetic oligonucleotide
gaaggtttgctggttttcactgg

SEQ ID NO: 325 - DNA, 23 bp, Artificial Sequence
  Description of Artificial Sequence: Synthetic oligonucleotide
ggaggtggagagatttgcacagg

SEQ ID NO: 326 - DNA, 23 bp, Artificial Sequence
  Description of Artificial Sequence: Synthetic oligonucleotide
ggaggtgaactgggcttcatggg

SEQ ID NO: 327 - DNA, 26 bp, Nicotiana benthamiana
ccgtttgcaagctttagaagcccttg

SEQ ID NO: 328 - DNA, 23 bp, Nicotiana benthamiana
ggcttttgagaattctaatgagg

SEQ ID NO: 329 - DNA, 23 bp, Nicotiana benthamiana
ccaaacatccaagactttgcgcc

What is claimed is:

1. A method of targeting a single locus for mutagenesis, said method comprising:
selecting a locus for mutagenesis; and
contacting a genomic sample comprising the locus to a chimeric polypeptide comprising an exonuclease selected from the group consisting of: a RecE, a RecJ, a RecBCD, a Mungbean nuclease, an ExoIII, and an ExoVII, and a programmable endonuclease that binds to the locus and is selected from the group consisting of: a Cas9 and a Cpf 1, thereby generating a modified locus, thereby modifying an unique segment of the genomic sample, wherein the modifying comprises mutagenizing, inserting, or deleting at most 40 bases.

2. The method of claim 1, wherein said selecting comprises identifying a unique segment of at least 10 bases in the genomic sample.

3. The method of claim 1, wherein said contacting occurs in vivo.

4. The method of claim 3, wherein said contacting comprises transfecting a cell using a vector encoding the enzyme.

5. The method of claim 3, wherein said contacting comprises bombarding a cell using a nucleic acid encoding the enzyme.

6. The method of claim 5, wherein said bombarding comprises contacting to at least one gold particle.

7. The method of claim 5, wherein said bombarding comprises contacting to at least one tungsten particle.

8. The method of claim 3, wherein said contacting comprises vacuum infiltration.

9. The method of claim 3, wherein said contacting comprises *Agrobacterium*-mediated transformation.

10. The method of claim 3, wherein said contacting comprises stable transformation.

11. The method of claim 3, wherein said contacting comprises transient expression.

12. The method of claim 1, wherein said exonuclease comprises an Exo1 exonuclease activity.

13. The method of claim 1, wherein said exonuclease comprises 5'-3' overhang exonuclease activity.

14. The method of claim 1, wherein said exonuclease comprises double-stranded nucleic acid exonuclease activity.

15. The method of claim 1, wherein said exonuclease does not exhibit single stranded nucleic acid exonuclease activity.

16. The method of claim 1, further comprises sequencing across the locus for identifying a mutation or a deletion relative to the locus prior to contacting.

17. The method of claim 1, further comprises sequencing a substantial portion of the genomic sample aside from the locus comprising sequencing at least 1%, at least 5%, at least 10%, or at least 50% of a genome copy of the genomic sample.

18. The method of claim 1, wherein said contacting occurs in vivo, and wherein said method comprises sequencing a substantial portion of the genomic sample aside from the locus is performed subsequent to at least one cell division subsequent to said contacting.

19. The method of claim 1, comprising contacting the genomic sample to a composition comprising a buffer comprising Zinc ion.

20. The method of claim 1, comprising contacting the genomic sample to a composition comprising a buffer comprising Zinc sulfate.

21. The method of claim 1, wherein the exonuclease and the programmable endonuclease are fused in frame, wherein the chimeric polypeptide exhibits enhanced on target mutagenesis compared to a sequence specific endonuclease and wherein the chimeric polypeptide exhibits the same or lower off target mutagenesis compared to the sequence specific endonuclease when unfused.

22. A polypeptide comprising a sequence-specific endonuclease fused in frame to a DNA binding protein (DBP), wherein the DBP binds single-stranded DNA or double-stranded DNA, wherein the sequence-specific endonuclease is selected from the group consisting of: a Cas9 and a Cpf 1.

23. A polypeptide comprising a sequence-specific endonuclease fused in frame to a terminal deoxyribonucleotidyl transferase (TdT), wherein the sequence-specific endonuclease is selected from the group consisting of: a Cas9 and a Cpf 1.

24. The method of claim 1, wherein the programmable endonuclease is the Cas9.

25. The method of claim 24, wherein the Cas9 is SpCas9.

26. The method of claim 1, wherein the programmable endonuclease is the Cpf1.

* * * * *